US009115389B2

(12) United States Patent
Gilad et al.

(10) Patent No.: US 9,115,389 B2
(45) Date of Patent: Aug. 25, 2015

(54) METHOD FOR DETECTING A TARGET NUCLEIC ACID COMPRISING TWO PORTIONS USING PROBES HAVING A FIRST PORTION COMPLEMENTARY TO THE FIRST PORTION OF THE TARGET NUCLEIC ACID AND A SECOND PORTION SUBSTANTIALLY COMPLEMENTARY TO THE SECOND PORTION OF THE TARGET NUCLEIC ACID

(75) Inventors: Shlomit Gilad, Ganei Hadar (IL); Esther Meiri, Shoham (IL)

(73) Assignee: Rosetta Genomics Ltd., Rehovot (IL)

( * ) Notice: Subject to any disclaimer, the term of this patent is extended or adjusted under 35 U.S.C. 154(b) by 1003 days.

(21) Appl. No.: 12/308,954

(22) PCT Filed: Jun. 29, 2007

(86) PCT No.: PCT/IB2007/003732
§ 371 (c)(1),
(2), (4) Date: Apr. 2, 2009

(87) PCT Pub. No.: WO2008/029295
PCT Pub. Date: Mar. 13, 2008

(65) Prior Publication Data
US 2010/0047784 A1 Feb. 25, 2010

Related U.S. Application Data

(60) Provisional application No. 60/806,404, filed on Jun. 30, 2006, provisional application No. 60/822,371, filed on Aug. 14, 2006, provisional application No. 60/850,455, filed on Oct. 10, 2006, provisional application No. 60/871,095, filed on Dec. 20, 2006.

(51) Int. Cl.
*C12P 19/34* (2006.01)
*C12Q 1/68* (2006.01)

(52) U.S. Cl.
CPC ............ *C12Q 1/6816* (2013.01); *C12Q 1/6832* (2013.01); *C12Q 1/6853* (2013.01); *C12Q 1/6886* (2013.01); *C12Q 2600/136* (2013.01); *C12Q 2600/178* (2013.01)

(58) Field of Classification Search
CPC ................ C12Q 1/6853; C12Q 1/686; C12Q 2525/207; C12Q 2600/178
USPC ..................................................... 435/91.21
See application file for complete search history.

(56) References Cited

U.S. PATENT DOCUMENTS

| | | | |
|---|---|---|---|
| 5,034,506 A | 7/1991 | Summerton et al. | |
| 5,124,246 A | 6/1992 | Urdea et al. | |
| 5,235,033 A | 8/1993 | Summerton et al. | |
| 5,359,100 A | 10/1994 | Urdea et al. | |
| 5,545,730 A | 8/1996 | Urdea et al. | |
| 5,571,670 A | 11/1996 | Urdea et al. | |
| 5,580,731 A | 12/1996 | Chang et al. | |
| 5,591,584 A | 1/1997 | Chang et al. | |
| 5,594,117 A | 1/1997 | Urdea et al. | |
| 5,594,118 A | 1/1997 | Urdea et al. | |
| 5,597,909 A | 1/1997 | Urdea et al. | |
| 5,635,352 A | 6/1997 | Urdea et al. | |
| 5,681,697 A | 10/1997 | Urdea et al. | |
| 5,681,702 A | 10/1997 | Collins et al. | |
| 5,780,233 A | 7/1998 | Guo et al. | |
| 6,653,081 B2 | 11/2003 | Whitcomb | |
| 6,730,479 B2 | 5/2004 | Schultz et al. | |
| 6,797,464 B2 | 9/2004 | Stevenson et al. | |
| 6,913,753 B2 | 7/2005 | Ramachandran et al. | |
| 7,642,348 B2 | 1/2010 | Bentwich et al. | |
| 8,192,937 B2 | 6/2012 | Jacobsen et al. | |
| 2002/0102557 A1* | 8/2002 | Gentile-Davey et al. | 435/6 |
| 2002/0115080 A1 | 8/2002 | Skouv et al. | |
| 2003/0108913 A1 | 6/2003 | Schouten et al. | |
| 2003/0194699 A1 | 10/2003 | Lewis et al. | |
| 2005/0059048 A1 | 3/2005 | Gunderson et al. | |
| 2005/0064457 A1 | 3/2005 | Lee | |
| 2005/0107325 A1 | 5/2005 | Manoharan et al. | |
| 2005/0112554 A1 | 5/2005 | Zhao et al. | |
| 2005/0123959 A1 | 6/2005 | Williams et al. | |
| 2005/0143795 A1 | 6/2005 | Habib et al. | |
| 2005/0182005 A1 | 8/2005 | Tuschl et al. | |
| 2005/0214753 A1 | 9/2005 | Schultz et al. | |
| 2007/0042380 A1 | 2/2007 | Bentwich et al. | |
| 2008/0182237 A1 | 7/2008 | Bentwich et al. | |

FOREIGN PATENT DOCUMENTS

| | | |
|---|---|---|
| CA | 1296242 C | 2/1992 |
| EP | 0167238 B1 | 1/1986 |
| EP | 1 130 119 A1 | 9/2001 |
| EP | 1 683 872 A1 | 7/2006 |
| EP | 1 889 924 A1 | 2/2008 |
| WO | WO 03/012135 A2 | 2/2003 |

(Continued)

OTHER PUBLICATIONS

Hurtle et al., Detection of the *Bacillus anthracis* gyrA gene by using a minor groove binder probe, J Clin Microbiol. Jan. 2004;42(1):179-85.*

Schena et al., Real-time quantitative PCR: a new technology to detect and study phytopathogenic and antagonistic fungi, European Journal of Plant Pathology 110: 893-908, 2004.*

Afonina et al., Minor Groove Binder-Conjugated DNA Probes for Quantitative DNA Detection by Hybridization-Triggered Fluorescence, BioTechniques 32:940-949 (Apr. 2002).*

(Continued)

*Primary Examiner* — Cynthia B Wilder
(74) *Attorney, Agent, or Firm* — Ron Galant; Polsinelli PC

(57) ABSTRACT

Described herein are methods and compositions for detecting, amplifying and labeling targeted nucleic acids, including microRNAs.

10 Claims, 15 Drawing Sheets

(56) References Cited

FOREIGN PATENT DOCUMENTS

| WO | WO 03/044228 A1 | 5/2003 |
| WO | WO 2005/116250 A2 | 12/2005 |
| WO | WO 2006/126040 A1 | 11/2006 |
| WO | WO 2007/090345 A1 | 8/2007 |

OTHER PUBLICATIONS

Kutyavin et. al., Nucleic Acids Research, vol. 28, No. 2., pp. 655-661, 2000.*

U.S. Appl. No. 10/709,577, filed May 14, 2004, Bentwich, et al.

U.S. Appl. No. 11/384,049.

Soutschek et al., "Therapeutic silencing of an endogenous gene by systemic administration of modified siRNAs" *Nature*, 2004, 432:173-178.

Siepel et al, "Combining Phylogenetic and Hidden Markov Models in Biosequence Analysis," *Journal of Computational Biology*, 2004, 11:413-428.

Schwartz et al., "Human-Mouse Alignments with BLASTZ," *Genome Research*, 2003, 13:103-107.

Berezikov et al., "Phylogenetic Shadowing and Computational Identification of Human microRNA Genes," *Cell*, 2005, 120:21-24.

Pruitt et al., "NCBI Reference Sequence (RefSeq): a curated non-redundant sequence database of genomes, transcripts and proteins," *Nucleic Acids Research*, 2005, 33:D501-D504.

Pruitt et al., "Introducing RefSeq and LocusLink: curated human genome resources at the NCBI," *Trends Genet.*, 2000, 16:44-47.

Tatusova et. al., "Complete genomes in WWW Entrez: data representation and anal ysis," *Bioinformatics*, 1999, 15:536-543.

Lewis et al., "Conserved Seed Pairing, Often Flanked by Adenosines, Indicates that Thousands of Human Genes are MicroRNA Targets," *Cell*, 2005, 120:15-20.

Lim et al., "Microarray analysis shoes that some microRNAs downreglate large numbers of target mRNAs," *Nature*, 2005, 433:769-773.

Baskerville et al., "Microarray profiling of microRNAs reveals frequent coexpression with neighboring miRNAs and host genes," *RNA*, 2005, 11:241-247.

Rodriguez et al., "Identification of Mammalian microRNA Host Genes and Transcript Units," *Genome Research*, 2004, 14:1902-1910.

Chen et al., "Real-time quantification of microRNAs by stem-loop RT-PCR," *Nucleic Acids Research*, 2005, 33:e179.

Fu et al., "A Novel Method to Monitor the Expression of microRNAs," *Molecular Biotechnology*, 2006, 32:197-204.

Shi et al., "Facile means for quantifying microRNA expression by real-time PCR," *BioTechniques*, 2005, 39:519-525.

Tang et al., "MicroRNA expression profiling of single whole embryonic stem cells," *Nucleic Acids Research*, 2006, 34:e9.

Schouten et al., *Relative Quantification of 40 Nucleic Acid Sequences by Multiplex Ligation-Dependent Probe Amplification*, Nucleic Acids Res. 2002, vol. 30, No. 12e57.

International Search Report dated Feb. 22, 2011, in corresponding PCT Application No. PCT/IB07/03732, 6 pages.

Jiang Jinmai et al.: "Real-time expression profiling of microRNA precursors in human cancer cell lines":, Nucleatic Acids Research, Oxford University Press, GB, vol. 33, No. 17, Jan. 1, 2005, pp. 5394-5403, XP002489966, ISSN:1362-4962.

Allawi Hatim T et al: "Quantitation of microRNAs using a modified Invader assay", RNA, Cold Spring Harbor Laboratory Press, US, vol. 10, No. 7, pp. 1153-1161 ISSN: 1355-8382; Jul. 1, 2004, XP002384569.

Schuetz E et al: "Spreadsheet Software for Thermodynamic Melting Point Prediction of Oligonucleotide Hybridization With and Without Mismatches", Biotechniques, Informa Healthcare, US, vol. 27, No. 6, Dec. 1, 1999, pp. 1218-1224, XP002948493, ISSN: 0736-6205.

European Search Report dated Apr. 18, 2012.

Guo Z et al: "Enhanced Discrimination of Single Nucleotide Polymorhisms by Artificial Mismatch Hybridization" Nature Biotechnology, vol. 15, Apr. 1, 1997, (pp. 331-335, XP000867755, ISSN: 1087-0156, DOI: 10.1038/NBT0497-331.

Conner B J et al.: "Detection of Sickle Cell Betas-Globin Allele by Hybridization with Synthetic Oligonucleotides", Proceedings of the National Academy of Sciences, vol. 80, Jan. 1, 1983, pp. 278-282, XP009009982, ISSN:0027-8424.

* cited by examiner

Fig. 2A
1) hsa-let-7a:
5'-UGAGGUAGUAGGUUGUAUAGUU -3'
(SEQ ID NO:20840)

Fig. 2B
2) Polyadenylation:
5'-UGAGGUAGUAGGUUGUAUAGUUAAAAAAAAAAAAAAAA-3'
(SEQ ID NO:21064)

Fig. 2C
3) Reverse Transcription:
5'-UGAGGUAGUAGGUUGUAUAGUUAAAAAAAAAAAAAAAA-3' (SEQ ID NO:21064)
                                                              (adaptor)
       3'-NVTTTTTTTTTTT GGATATCACTCAGCATAATTAAGACACGAGCG-5'
                        (SEQ ID NO:20857)

5'-UGAGGUAGUAGGUUGUAUAGUUAAAAAAAAAAAAAAAA-3' (SEQ ID NO:21064)
3'-ACTCCATCATCCAACATATCAATTTTTTTTTTTTTTTTGGATATCACTCAGCATAATTAAGACACGAGCG-5'
(SEQ ID NO:21072)

Fig. 2D
4) Real Time PCR
5'-TGAGGTAGTAGGTTGTATAGTTAAAAAAAAAAAAAAAACCTATAGTGAGTCGTATTAATTCTGTGCTCGC-3' (SEQ ID NO:21073)
3'-ACTCCATCATCCAACATATCAATTTTTTTTTTTTTTTTGGATATCACTCAGCATAATTAAGACACGAGCG-5' (SEQ ID NO:21072)

5'-TGAGGTAGTAGGTTGTATAGTTAAAAAAAAAAAAAAAACCTATAGTGAGTCGTATTAATTCTGTGCTCGC-3' (SEQ ID NO:21073)
                                                 (Rev primer) 3'-CAGCATAATTAAGACACGAGCG-5' (SEQ ID NO:20859)

5'-TGAGGTAGTAGGTTGTATAGTT-3' (Fwd primer) (SEQ ID NO:20840)
3'-ACTCCATCATCCAACATATCAATTTTTTTTTTTTTTTTGGATATCACTCAGCATAATTAAGACACGAGCG-5' (SEQ ID NO:21072)

Fig. 3A
1) hsa-let-7a:
5'-UGAGGUAGUAGGUUGUAUAGUU -3' (SEQ ID NO:20840)

Fig. 3B
2) Polyadenylation:
5'-UGAGGUAGUAGGUUGUAUAGUUAAAAAAAAAAAAAAAAAAAAA-3' (SEQ ID NO:21064)

Fig. 3C
3) Reverse Transcription:
5'-UGAGGUAGUAGGUUGUAUAGUUAAAAAAAAAAAAAAAAAAAAA-3' (SEQ ID NO:21064)
              3'-NVTTTTTTTTTTT GCCCATCACTCAGCATAATTAAGACACGAGCG-5' (adaptor)
              (SEQ ID NO:20836)

5'-UGAGGUAGUAGGUUGUAUAGUUAAAAAAAAAAAAAAAAAAAAA-3' (SEQ ID NO:21064)
3'-ACTCCATCATCCAACATATCAATTTTTTTTTTTTTTTTTTTTTGCCCATCACTCAGCATAATTAAGACACGAGCG-5'
              (SEQ ID NO:21068)

Fig. 3D
4) Real Time PCR
5'-TGAGGTAGTAGGTTGTATAGTTAAAAAAAAAAAAAAAAAAAAACGGGTAGTGAGTCGTATTAATTCTGTGCTCGC-3' (SEQ ID NO:21069)
3'-ACTCCATCATCCAACATATCAATTTTTTTTTTTTTTTTTTTTTGCCCATCACTCAGCATAATTAAGACACGAGCG-5' (SEQ ID NO:21070)

5'-TGAGGTAGTAGGTTGTATAGTTAAAAAAAAAAAAAAAAAAAAACGGGTAGTGAGTCGTATTAATTCTGTGCTCGC-3' (SEQ ID NO:21069)
                                              CAGCATAATTAAGACACGAGCG-5' (SEQ ID NO:20859)
                                              (Reverse primer)

5'-TGAGGTAGTAGGTTGTATAGTT-3' Fwd primer with 5' over-hanged tail (SEQ ID NO:21071)
3'-BQ- CATATCAATTTTTTTTTTTTTTGCC -FAM-5' (Taqman probe) SEQ ID NO:8592
5'-CAGTCATTTGGG TGAGGTAGTAGGTTGTATAGTT-3'
3'-ACTCCATCATCCAACATATCAATTTTTTTTTTTTTTTTTTTTTGCCCATCACTCAGCATAATTAAGACACGAGCG-5'
              (SEQ ID NO:21070)

Fig. 4A
1) hsa-let-7a:
5'-UGAGGUAGUAGGUUGUAUAGUU-3' (SEQ ID NO:20840)

2) Polyadenylation:
5'-UGAGGUAGUAGGUUGUAUAGUUAAAAAAAAAAAAAAAAAA-3' (SEQ ID NO:21064)

3) Reverse Transcription:
5'-UGAGGUAGUAGGUUGUAUAGUUAAAAAAAAAAAAAAAAAA-3' (SEQ ID NO:21064)     Fig. 4C
3'-NVTTTTTTTTTTT GCGCATCACTCAGCATAATTAAGACACGAGCG-5'
                                    (adaptor)
                               (SEQ ID NO:21067)

Fig. 4B

5'-UGAGGUAGUAGGUUGUAUAGUUAAAAAAAAAAAAAAAAAA-3' (SEQ ID NO:21064)
3'-ACTCCATCATCCAACATATCAATTTTTTTTTTTTTTTTTTTGCGCATCACTCAGCATAATTAAGACACGAGCG-5'
                                                                    (SEQ ID NO:21065)

Fig. 4D
4) Real Time PCR
5'-TGAGGTAGTAGGTTGTATAGTTAAAAAAAAAAAAAAAAAACGCGTAGTGAGTCGTATTAATTCTGTGCTCGC-3' (SEQ ID NO:21066)
3'-ACTCCATCATCCAACATATCAATTTTTTTTTTTTTTTTTTTGCGCATCACTCAGCATAATTAAGACACGAGCG-5' (SEQ ID NO:21065)

3'-BQ- CATATCAATTTTTTTTTTTGCC -FAM-5'
                                    (Taqman probe) SEQ ID NO:20846

5'-TGAGGTAGTAGGTTGTATAGTTAAAAAAAAAAAAAAAAAACGCGTAGTGAGTCGTATTAATTCTGTGCTCGC-3' (SEQ ID NO:21066)
                                          CAGCATAATTAAGACACGAGCG-5' (SEQ ID NO:20859)
                                              (Reverse primer)

5'-TGAGGTAGTAGGTTGTGTATAGTTAAAAAAAAAAAAAAAAACGCGTAGTGAGTCGTATTAATTCTGTGCTCGC-3' (SEQ ID NO:21066)
5'-CAGTCATTTGGGTGAGTCGTAGTAGGTTGT-3' (Fwd primer with 5' over-hanged tail) (SEQ ID NO:8082)
3'-ACTCCATCATCCAACATATCAATTTTTTTTTTTTTTTTTTTGCGCATCACTCAGCATAATTAAGACACGAGCG-5'
                                                                    (SEQ ID NO:21065)

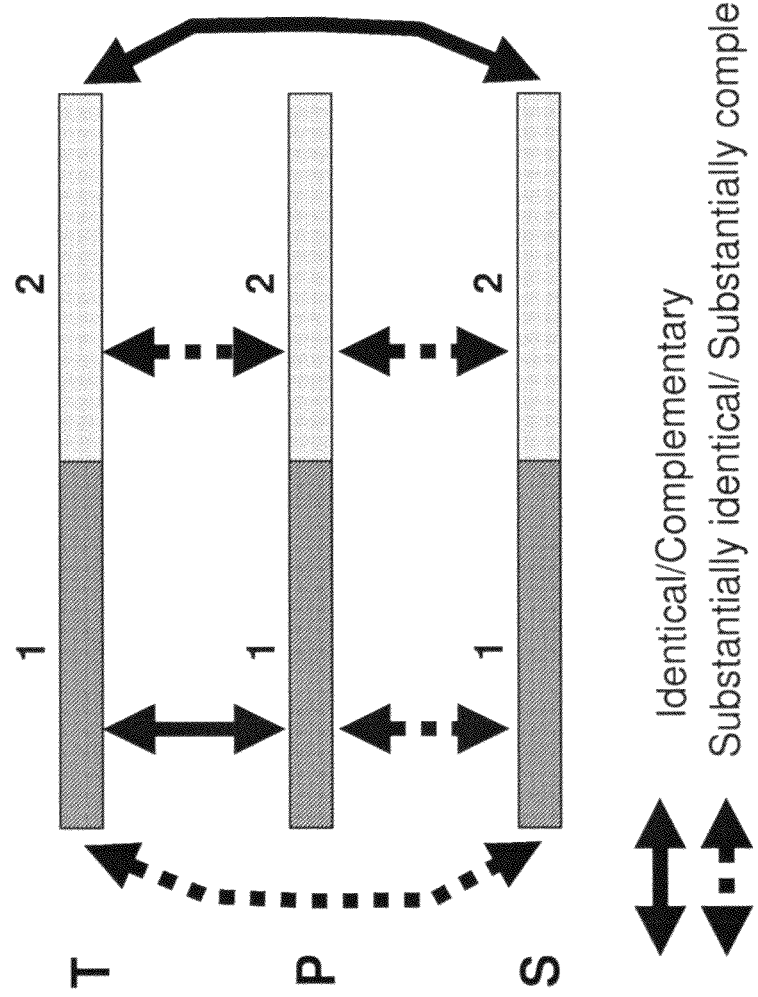

METHOD FOR DETECTING A TARGET NUCLEIC ACID COMPRISING TWO PORTIONS USING PROBES HAVING A FIRST PORTION COMPLEMENTARY TO THE FIRST PORTION OF THE TARGET NUCLEIC ACID AND A SECOND PORTION SUBSTANTIALLY COMPLEMENTARY TO THE SECOND PORTION OF THE TARGET NUCLEIC ACID

FIELD OF THE INVENTION

The invention relates in general to methods and compositions for detecting, amplifying and labeling nucleic acid molecules, including microRNAs.

BACKGROUND OF THE INVENTION

The identification and quantification of specific nucleic acid sequences has been an area of great interest in molecular biology over the past two decades. Expression profiles within the area of identification and quantification of specific nucleic acids is currently being intensely studied. The ability to identify and quantify certain nucleic acids and their products has advanced a broad range of disciplines, such as individualized medicine, and evaluation of drug resistance.

While much has been learned about various methods for identifying and quantifying specific nucleic acid sequences, these methods lack accuracy and precision for identifying small variations in nucleic acid sequences, resulting in a high level of false positives and an inability to broadly apply these methods. Methods for identifying target nucleic acids with specific single base polymorphisms have proven to be ineffective when these nucleic acids are present in a high background of other nucleic acids including nucleic acids with sequences similar to the target nucleic acids. Probe design has limited the number of different variable nucleic acids that can be identified at a time, and require controlled backgrounds of known nucleic acids. Probes associated with methods such as Real Time PCR for detecting particular nucleic acid variants including microRNAs (miRNAs) have also been problematic because of non-specific binding to RT primers and lack of sufficient sensitivity to the target sequences.

miRNAs are short RNA oligonucleotides of approximately 22 nucleotides that are involved in gene regulation. miRNAs regulate gene expression by targeting mRNAs for cleavage or translational repression. The role of miRNAs in the development and progression of disease has only recently become appreciated. Deregulated miRNA expression is implicated in onset and progression of different diseases including, but not limited to embryonic malformations and cancers.

As a result of their small size, miRNAs have been difficult to identify using standard methodologies. A limited number of miRNAs have been identified by extracting large quantities of RNA. miRNAs have also been identified that contribute to the presentation of visibly discernable phenotypes. Expression array data shows that miRNAs are expressed in different developmental stages or in different tissues.

Moreover, because of their potential broad use in treating and diagnosing different diseases, there is a need in the art (yet unmet) to develop methods of identification, isolation and also quatitation of miRNAs. The present invention addresses the need by disclosing efficient and sensitive methods and compositions for isolating and quantitating miRNAs from different samples, including those wherein there is only minimum amount of a starting material available.

SUMMARY OF THE INVENTION

A method of detecting a target nucleic acid is provided. The method may comprise providing a sample comprising a target nucleic acid, wherein the target nucleic acid comprises a first portion and a second portion, and contacting the target nucleic acid with a probe. The probe may comprise a first portion complementary to the first portion of the target nucleic acid, and a second portion that is substantially complementary to the second portion of the target nucleic acid. The level of probe binding to the target nucleic acid may be compared to a control and may be indicative of the level of target nucleic acid present in the sample.

A method of detecting a target nucleic acid amongst one or more other nucleic acids is also provided. The method may comprise providing a sample comprising a target nucleic acid and a sibling nucleic acid, wherein the target nucleic acid comprises a first portion and a second portion, and the sibling nucleic acid comprises a first portion and a second portion. The method may further comprise contacting the target nucleic acid with a probe. The first portion of the target nucleic acid and first portion of the sibling nucleic acid are substantially identical. The first portion of the sibling nucleic acid is substantially complementary to the first portion of the probe. The second portion of the sibling nucleic acid is substantially complementary to the second portion of the probe. The level of probe binding to the target nucleic acid may be compared to a control and may be indicative of the level of target nucleic acid present in the sample.

A method of detecting a plurality of target nucleic acids in a sample is also provided. Each target nucleic acid may comprise a first portion and a second portion. The method may comprise providing a sample containing a plurality of target nucleic acids and contacting the target nucleic acids with a plurality of probes. The sample may also comprise a plurality of sibling nucleic acids. Each probe may be capable of distinguishing a target nucleic acid from a sibling nucleic acid in the sample. Each sibling nucleic acid comprises a first portion and a second portion. The first portion of the sibling nucleic acid is substantially complementary to the first portion of the sibling nucleic acid. Each probe of the method may comprise a first portion complementary to the first portion of one of the target nucleic acids and a second portion substantially complementary to the second portion of one of the target nucleic acids. The level of each probe binding to each target nucleic acid may be compared to a control is indicative of the level of each target nucleic acid present in the sample.

A method of detecting a target nucleic acid amongst one or more other sibling nucleic acids is also provided. The method may comprise providing a sample comprising a target nucleic acid comprise a first portion and second portion, and contacting the sample with a probe comprising a first portion and a second portion. The first portion of the target nucleic acid may comprise a variant site. The sibling nucleic acid may also comprise a first portion and second portion. The first portion of the sibling nucleic acid may also comprise a variant site. The variant site of the target nucleic acid may differ from the variant site of the sibling nucleic acid by as few as one nucleotide. The first portion of the probe may comprise a detection site that is complementary to the variant site of the target nucleic acid but is noncomplementary to the variant site of the sibling nucleic acid. The probe may also comprise a sensitizing site in the second portion that is substantially complementary to the second portion of both the target nucleic acid and the sibling nucleic acid. The probe may allow specific detection of the target nucleic acid in a diverse background of other substantially identical sibling nucleic acids ranging in concentration from low to high.

The target nucleic acid of the method may be mRNA, miRNA, pri-mRNA, pre-mRNA, siRNA, anti-miRNA, DNA, or cDNA. The target nucleic acid may be isolated from bacteria, viruses, animals, or humans. The target nucleic acid may be amplified. The amplification of the target nucleic acid may be by polymerase chain reaction using forward and reverse primers wherein the forward primer may comprise a sequence selected from the group consisting of any one of SEQ ID NOS: 4168-8334. The probe of the method may comprise a label, which may be fluorophore. The label may further comprise a quencher molecule. The fluorophore may be distal to the quencher molecule. The probe may comprise a sequence selected from the group consisting of any one of SEQ ID NOS: 8335-20835. The sample of the method may be a biological sample. The biological sample may be selected from the group consisting of blood, a blood fraction, amniotic fluid, urine, ascetic fluid, saliva, cerebrospinal fluid, cervical secretions, vaginal secretions, endometrial secretions, gastrointestinal secretions, bronchial secretions, sputum, pleural effusion, secretions from the breast, secretions from ovarian cyst, sperm, cell line and tissue sample.

A method for detecting a disease or condition is also provided. The method may comprise providing a sample wherein the sample has a target nucleic acid and a sibling nucleic acid. The method may further comprise contacting the target nucleic acid with a probe. The method may also comprise measuring a difference in the level of a target nucleic acid to a control, which is indicative of the disease or condition or the presence of a viral or bacterial infection. The disease or condition may be cancer, HIV, Hepatitis B or human papilloma virus infection.

A method for genotyping an individual is also provided. The method may comprise providing a sample where the sample has a target nucleic acid and a sibling nucleic acid. The method may further comprise contacting the target nucleic acid with a probe. The method may also comprise measuring the difference in the level of a target nucleic acid to a control, which is indicative of the genotype of the individual.

A method for identifying microRNA expression in a body-fluid sample obtained from a subject is also provided. The method may comprise providing RNA from said sample, wherein said RNA comprises a microRNA. The method may further comprise generating a reverse transcript of the polyadenylated RNA and amplifying the reverse transcript by polymerase chain reaction comprising a forward primer, a reverse primer, and a probe. The body-fluid sample is selected from the group consisting of: blood, serum, urine, amniotic fluid, ascitic fluid, saliva, cervical secretions, vaginal secretions, endometrial secretions, gastrointestinal secretions, bronchial secretions, sputum, pleural effusion, secretions from the breast, secretions from ovarian cyst, and sperm.

The forward primer may comprise a sequence selected from the group consisting of any one of SEQ ID NOS: 4168-8334. The probe may comprise a sequence selected from the group consisting of any one of SEQ ID NOS: 8335-20835.

A biochip is also provided. The biochip may comprise a plurality of probes. The probes may comprise negative probes, positive probes, spike probes, and test probes. A negative probe may comprise a nucleic acid substantially complementary to a miRNA*. The sequence of the nucleic acid may be selected from the group consisting of any one of SEQ ID NOS: 20863-20925. A positive probe may comprise a nucleic acid substantially complementary to a small RNA. The sequence of the nucleic acid may be selected from the group consisting of any one of SEQ ID NOS: 20926-20937. A spike probe may comprise a nucleic acid with a sequence that is not complementary to any sequence of 60 nucleotides in a genome which may be human, rat, virus or mouse. The sequence of the nucleic acid may be selected from the group consisting of any one of SEQ ID NOS: 20938-20951.

A test probe may comprise 40 to 60 nucleotides. A test probe may comprise a nucleic acid that is substantially complementary to a miRNA. The nucleic acid may comprise 16 to 29 nucleotides. The sequence of the nucleic acid may be selected from the group consisting of any one of SEQ ID NOS: 1-4167. The test probe may also comprise a linker. The linker may comprise a nucleic acid, wherein the sequence of the nucleic acid may be selected from the group consisting of any one of SEQ ID NOS: 20952-21063. Also provided is a method of detecting a nucleic acid. A biological sample may be provided. The biochip may be contacted with the biological sample. The level of a nucleic acid may be measured. A difference in the level of the nucleic acid compared to a control may be indicative the nucleic acid being detected in the biological sample. The nucleic acid may be a pri-miRNA, a pre-miRNA, or a miRNA. The nucleic acid may be labeled with a fluorophore.

A direct and robust way to label microRNAs (miRNAs) is also provided. Also provided are a methods for detecting and measuring relative levels of miRNAs using LUMINEX® technology, and methods of calibrating the detection method. LUMINEX® provides a "solution based biochip" method. The methods describer herein may be applied to other similar platforms.

BRIEF DESCRIPTION OF THE DRAWINGS

FIGS. 2A-D are a schematic of the method of Shi and Chiang (2005). Following total RNA extraction (FIG. 2A), a polyadenylation reaction is performed (FIG. 2B). Next, the products are reverse transcribed using a poly(T) adapter linked to a specific tail, creating cDNA (FIG. 2C). Following this stage, a real time PCR reaction is performed using SYBR Green as a fluorophore, enabling the quantification of product accumulation (FIG. 2D).

FIGS. 3A-D are a schematic representation of a method of detection provided by the present invention. The target miRNA in this example is from the human let-7a family.

FIGS. 4A-D are another schematic representation of a method of detection provided by the present invention, in which there is a base mismatch between the sequence introduced by the adaptor during reverse transcription of polyadenylated target nucleic acid and the probe (FIG. 4D). The target miRNA in this example is from the human let-7a family.

FIG. 5 is a schematic representation of the method for detecting a target nucleic acid. Three nucleic acids are represented, each comprising a first portion (marked by a "1") and a second portion (marked by a "2"). A target nucleic acid is indicated by the letter T, a probe is indicated by the letter P, and a sibling nucleic acid is indicated by the letter S. A straight arrow drawn between two nucleic acid portions indicates that the sequences of the two portions are either identical or complementary. A dashed arrow drawn between two portions indicates that the sequences of the two portions are either substantially identical or substantially complementary. The first portions of the target nucleic acid and sibling nucleic acid are substantially identical, while the second portions of the target nucleic acid and sibling nucleic acid are identical. The second portions of the probe and the target nucleic acid are substantially complementary, as are the second portions of the probe and the sibling nucleic acid. This substantial complementarity allows the probe to distinguish the target nucleic acid from its sibling nucleic acid, because the first portion of the probe is identical to the first portion of the target nucleic acid, but only substantially complementary to the sibling nucleic acid.

DETAILED DESCRIPTION

Figure 1:
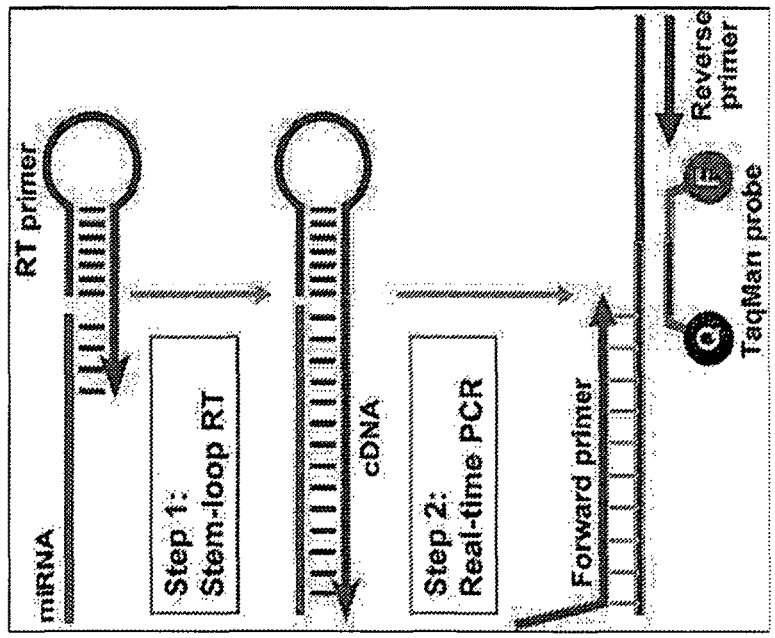
FIG. 1 is a schematic description of TaqMan miRNA assays. TaqMan-based real time quantification of miRNAs includes two steps, stem-loop reverse transcription (RT) and real time PCR. Stem-loop RT primers bind to the 3' portion of miRNA molecules and are reverse transcribed with reverse transcriptase. Then, the RT product is quantified using conventional TaqMan PCR that includes miRNA-specific forward primer, reverse primer and a dye-labeled TaqMan probe. The purpose of tailed forward primer at 5' is to increase its melting temperature (Tm) depending on the sequence composition of miRNA molecules.

Provided herein are methods for detecting a target nucleic acid. The method comprising contacting the target nucleic acid with a probe that has at least one mismatch to the target nucleic acid. The mismatch may allow the probe to distinguish the target nucleic acid from other nucleic acids that are substantially identical to the target nucleic acid and that differ from the target nucleic acid by as few as one nucleotide. The ability of the probe to distinguish the target nucleic acid over other substantially identical nucleic acids may be due to the presence of at least one additional mismatch between the probe and the other substantially identical nucleic acids. The method may allow specific detection of a target nucleic acid in a diverse background of other substantially identical nucleic acids ranging in concentration from low to high.

Also provided are methods and compositions that may be useful, among other things, for diagnostic and prognostic purposes.

Other aspects of the invention will become apparent to the skilled artisan by the following description of the invention.

1. Definitions

Before the present materials and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise. For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

a. Animal

"Animal" as used herein may mean fish, amphibians, reptiles, birds, and mammals, such as mice, rats, rabbits, goats, cats, dogs, cows, apes and humans.

b. Anti-miRNA

"Anti-RNA" as used herein is a RNA that is capable of blocking the activity of a miRNA or miRNA*, such as by binding to the pri-miRNA, pre-miRNA, miRNA or miRNA* (e.g. antisense or RNA silencing), or by binding to the target binding site. The anti-miRNA may comprise a total of 5-100 or 10-60 nucleotides. The anti-miRNA may also comprise a total of at least 5-40 nucleotides. The sequence of the anti-miRNA may comprise (a) at least 5 nucleotides that are substantially complementary to the 5' of a miRNA and at least 5-12 nucleotides that are substantially identical to the flanking regions of the target site from the 5' end of the miRNA, for the purposes of binding to a miRNA and repressing its activity; or (b) at least 5-12 nucleotides that are substantially identical to the 3' of a miRNA and at least 5 nucleotide that are substantially complementary to the flanking region of the target site from the 3' end of the miRNA, for the purposes of inhibiting the ability of a miRNA to bind to its target. The sequence of the anti-miRNA may comprise the sequence of a anti-miRNA disclosed in U.S. patent application Ser. Nos. 11/384,049, 11/418,870 or 11/429,720, the contents of which are incorporated herein, or variants thereof.

c. Attached

"Attached" or "immobilized" as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin. Immobilization may also involve a combination of covalent and non-covalent interactions.

d. Biological Sample

"Biological sample" as used herein may mean a sample of biological tissue or fluid that comprises nucleic acids. Such samples include, but are not limited to, tissue or fluid isolated from animals. Biological samples may also include sections of tissues such as biopsy and autopsy samples, frozen sections taken for histologic purposes, hair, and skin. Biological samples may also include explants and primary and/or transformed cell cultures derived from animal or patient tissues. Biological samples may also be blood, a blood fraction, plasma, serum, urine, pleural effusion, mucus, ascitic fluid, amniotic fluid, stool, tears, saliva, cerebrospinal fluid, cervical secretions, vaginal secretions, endometrial secretions, gastrointestinal secretions, bronchial secretions, sputum, secretions from ovarian cyst, sperm, secretions from the breast, cell line, or tissue sample. A biological sample may be provided by removing a sample of cells from an animal, but can also be accomplished by using previously isolated cells (e.g., isolated by another person, at another time, and/or for another purpose), or by performing the methods described herein in vivo. Archival tissues, such as those having treatment or outcome history (e.g., formalin fixed, paraffin-embedded (FFPE) tissues), may also be used.

e. Complement

"Complement" or "complementary" as used herein to refer to a nucleic acid may mean Watson-Crick (e.g., A-T/U and C-G) or Hoogsteen base pairing between nucleotides or nucleotide analogs of nucleic acid molecules.

f. Detection

"Detection" may mean detecting the presence of a component in a sample. Detection may also mean detecting the absence of a component. Detection may also mean measuring the level of a component, either quantitatively or qualitatively.

g. Differential Expression

"Differential expression" may mean qualitative or quantitative differences in the temporal and/or cellular gene expression patterns within and among cells and tissue. Thus, a differentially expressed gene may qualitatively have its expression altered, including an activation or inactivation, in, e.g., normal versus disease tissue. Genes may be turned on or turned off in a particular state, relative to another state thus permitting comparison of two or more states. A qualitatively regulated gene may exhibit an expression pattern within a state or cell type which may be detectable by standard techniques. Some genes may be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, real-time PCR, and RNase protection.

h. Gene

"Gene" used herein may be a natural (e.g., genomic) or synthetic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA or antisense RNA. A gene may also be an mRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

i. Groove Binder/Minor Groove Binder (MGB)

"Groove binder" and/or "minor groove binder" may be used interchangeably and refer to small molecules that fit into the minor groove of double-stranded DNA, typically in a sequence-specific manner. Minor groove binders may be long, flat molecules that can adopt a crescent-like shape and thus, fit snugly into the minor groove of a double helix, often displacing water. Minor groove binding molecules may typically comprise several aromatic rings connected by bonds with torsional freedom such as furan, benzene, or pyrrole rings. Minor groove binders may be antibiotics such as netropsin, distamycin, berenil, pentamidine and other aromatic diamidines, Hoechst 33258, SN 6999, aureolic anti-tumor drugs such as chromomycin and mithramycin, CC-1065, dihydrocyclopyrroloindole tripeptide ($DPI_3$), 1,2-dihydro-(3H)-pyrrolo[3,2-e]indole-7-carboxylate ($CDPI_3$), and related compounds and analogues, including those described in Nucleic Acids in Chemistry and Biology, 2d ed., Blackburn and Gait, eds., Oxford University Press, 1996, and PCT Published Application No. WO 03/078450, the contents of which are incorporated herein by reference. A minor groove binder may be a component of a primer, a probe, a hybridization tag complement, or combinations thereof. Minor groove binders may increase the $T_m$ of the primer or a probe to which they are attached, allowing such primers or probes to effectively hybridize at higher temperatures.

j. Identity

"Identical" or "identity" as used herein in the context of two or more nucleic acids or polypeptide sequences may mean that the sequences have a specified percentage of residues that are the same over a specified region. The percentage may be calculated by optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces one or more staggered ends and the specified region of comparison includes only a single sequence, the residues of single sequence are included in the denominator but not the numerator of the calculation. When comparing DNA and RNA, thymine (T) and uracil (U) may be considered equivalent. Identity may be performed manually or by using a computer sequence algorithm such as BLAST or BLAST 2.0.

k. Label

"Label" as used herein may mean a composition detectable by spectroscopic, photochemical, biochemical, immunochemical, chemical, or other physical means. For example, useful labels include $^{32}P$, fluorescent dyes, electron-dense reagents, enzymes (e.g., as commonly used in an ELISA), biotin, digoxigenin, or haptens and other entities which can be made detectable. A label may be a fluorophore, such as described in U.S. Pat. No. 6,541,618, the contents of which are incorporated herein by reference. A label may also be a quencher molecule, which when in proximity to another label, may decrease the amount of detectable signal of the other label, such as described in U.S. Pat. No. 6,541,618, the contents of which are incorporated herein by reference. A label may be incorporated into nucleic acids and proteins at any position.

l. miRNA

"miRNA" used herein may mean an RNA sequence capable of inhibiting a mRNA sequence. mRNA may mean include miRNA* or a variant thereof. The miRNA sequence may comprise from 13-33, 18-24 or 21-23 nucleotides. The miRNA may also comprise a total of at least 5-40 nucleotides. The sequence of the miRNA may be the first 13-33 nucleotides of the pre-miRNA. The sequence of the miRNA may also be the last 13-33 nucleotides of the pre-miRNA. The sequence of the miRNA may comprise the sequence of a miRNA disclosed in U.S. patent application Ser. Nos. 11/384,049, 11/418,870 or 11/429,720, the contents of which are incorporated herein, or variants thereof.

m. Nucleic Acid

"Nucleic acid" or "oligonucleotide" or "polynucleotide" used herein may mean at least two nucleotides covalently linked together. The depiction of a single strand also defines the sequence of the complementary strand. Thus, a nucleic acid also encompasses the complementary strand of a depicted single strand. Many variants of a nucleic acid may be used for the same purpose as a given nucleic acid. Thus, a nucleic acid also encompasses substantially identical nucleic acids and complements thereof. A single strand provides a probe that may hybridize to a target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be synthesized as a single stranded molecule or expressed in a cell (in vitro or in vivo) using a synthetic gene. Nucleic acids may be obtained by chemical synthesis methods or by recombinant methods.

The nucleic acid may also be a RNA such as a mRNA, tRNA, shRNA, siRNA or Piwi-interacting RNA, or a pri-miRNA, pre-miRNA, miRNA, or anti-miRNA, as described in U.S. patent application Ser. No. 11/429,720, 11/384,049, 11/418,870, 11/429,720, International Application Nos. PCT/IB05/02352, and PCT/EB2005/002702, the contents of which are fully incorporated herein by reference.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. Modified nucleotides also include nucleotides conjugated with cholesterol through, e.g., a hydroxyprolinol linkage as described in Krutzfeldt et al., Nature (Oct. 30, 2005), Soutschek et al., Nature 432:173-178 (2004), and U.S. Patent Publication No. 20050107325, which are incorporated herein by reference. Modified nucleotides and nucleic acids may also include locked nucleic acids (LNA), as described in U.S. Patent No. 20020115080, which is incorporated herein by reference. Additional modified nucleotides and nucleic acids are described in U.S. Patent Publication No. 20050182005, which is incorporated herein by reference. Modifications of the ribose-phosphate backbone may be done for a variety of reasons, e.g., to increase the stability and half-life of such molecules in physiological environments, to enhance diffusion across cell membranes, or as probes on a biochip. Mixtures of naturally occurring nucleic acids and analogs may be made; alternatively, mixtures of different nucleic acid analogs, and mixtures of naturally occurring nucleic acids and analogs may be made.

The nucleic acid may have a length of 10 to 30,000 nucleotides, 10-25,000 nucleotides, 10-20,000 nucleotides, 10-10,000 nucleotides, 10-5,000 nucleotides, 10-2,500 nucleotides, 10-1,000 nucleotides, 10-250 nucleotides, 10-100 nucleotides, and 10-50 nucleotides. The nucleic acid may have a length of at least 10, 11, 11, 12, 13, 14, 15, 16, 17, 18, 19, 20, 21, 22, 23, 24, 25-40, 40-70, 80-125, 125-175, 175-200, or 200-250 nucleotides.

n. Pre-mRNA

"Pre-mRNA" used herein may mean mRNA sequence comprising a miRNA and a miRNA*. The pre-miRNA sequence may comprise from 45-90, 60-80 or 60-70 nucleotides. The sequence of the pre-miRNA may also be that of a pri-miRNA excluding from 0-160 nucleotides from the 5' and 3' ends of the pri-miRNA. The sequence of the pre-miRNA may comprise the sequence of a pre-miRNA disclosed in U.S. patent application Ser. Nos. 11/384,049, 11/418,870 or 11/429,720, the contents of which are incorporated herein, or variants thereof.

o. Pri-mRNA

"Pri-mRNA" used herein may mean mRNA sequence comprising a pre-miRNA, miRNA, and miRNA*. The sequence of the pri-miRNA may comprise variants thereof. The sequence of the pri-miRNA may comprise the sequence of a pri-miRNA disclosed in U.S. patent application Ser. Nos. 11/384,049, 11/418,870 or 11/429,720, the contents of which are incorporated herein, or variants thereof. The pri-miRNA sequence may comprise from 45-30,000, 50-25,000, 100-20,000, 1,000-1,500 or 80-100 nucleotides.

The pri-miRNA may form a hairpin structure. The hairpin may comprise first and second nucleic acid sequences that are substantially complementary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides. The pri-miRNA may comprise at least 19% adenosine nucleotides, at least 16% cytosine nucleotides, at least 23% thymine nucleotides and at least 19% guanine nucleotides.

p. Stringent Hybridization Conditions

"Stringent hybridization conditions" used herein may mean conditions under which a first nucleic acid sequence (e.g., probe) will hybridize to a second nucleic acid sequence (e.g., target), such as in a complex mixture of nucleic acids. Stringent conditions are sequence-dependent and will be different in different circumstances. Stringent conditions may be selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, such as about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

q. Substantially Complementary

"Substantially complementary" used herein may mean that a first sequence is at least 50%, 55%, 60%, 65%, 70%, 75%, 80%, 85%, 90%, 95%, 97%, 98% or 99% identical to the complement of a second sequence over a region of 2, 3, 4, 5, 6, 7, 8, 9, 10, 11, 12, 13, 14, 15, 16, 17, 18, 19, 20-40, 40-60, 60-100, or more nucleotides, or that the two sequences hybridize under stringent hybridization conditions.

r. Substantially Identical

"Substantially identical" used herein may mean that a first and second sequence are at least 50%, 55%, 60%, 65%, 70%, 75%, 80%, 85%, 90%, 95%, 97%, 98% or 99% identical over a region of 2, 3, 4, 5, 6, 7, 8, 9, 10, 11, 12, 13, 14, 15, 16, 17, 18, 19, 20-40, 40-60, 60-100, or more nucleotides or amino acids, or with respect to nucleic acids, if the first sequence is substantially complementary to the complement of the second sequence.

s. Target Nucleic Acid

"Target nucleic acid" as used herein may mean a nucleic acid or variant thereof that may be bound by another nucleic acid. A target nucleic acid may be a DNA sequence. The target nucleic acid may be an RNA. The target nucleic acid may comprise a mRNA, tRNA, shRNA, siRNA or Piwi-interacting RNA, or a pri-miRNA, pre-miRNA, miRNA, or anti-miRNA. The target nucleic acid may comprise a target miRNA binding site or a variant thereof. One or more probes may bind the target nucleic acid. The target binding site may be comprise 5-100 or 10-60 nucleotides. The target binding site may comprise a total of 5, 6, 7, 8, 9, 10, 11, 12, 13, 14, 15, 16, 17, 18, 19, 20, 21, 22, 23, 24, 25, 26, 27, 28, 29, 30-40, 40-50, 50-60, 61, 62 or 63 nucleotides. The target site sequence may comprise at least 5 nucleotides of the sequence of a target miRNA binding site disclosed in U.S. patent application Ser. Nos. 11/384,049, 11/418,870 or 11/429,720, the contents of which are incorporated herein.

t. Variant

"Variant" as used herein to refer to a nucleic acid may mean (i) a portion of a referenced nucleotide sequence; (ii) the complement of a referenced nucleotide sequence or portion thereof; (iii) a nucleic acid that is substantially identical to a referenced nucleic acid or the complement thereof; or (iv) a nucleic acid that hybridizes under stringent conditions to the referenced nucleic acid, complement thereof, or a sequences substantially identical thereto.

2. Probes

A probe is provided herein. A probe may comprise a nucleic acid. The probe may have a length of from 8 to 500, 10 to 100 or 20 to 60 nucleotides. The probe may also have a length of at least 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 220, 240, 260, 280 or 300 nucleotides. The probe may comprise a nucleic acid of 18-25 nucleotides.

A probe may be capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. A probe may be single stranded or partially single and partially double stranded. The strandedness of the probe is dictated by the structure, composition, and properties of the target sequence. Probes may be directly labeled or indirectly labeled.

a. Linker Sequences

The probe may further comprise a linker. The linker may be 10-60 nucleotides in length. The linker may be 20-27 nucleotides in length. The linker may be of sufficient length to allow the probe to be a total length of 45-60 nucleotides. The linker may not be capable of forming a stable secondary structure, may not be capable of folding on itself, or may not be capable of folding on a non-linker portion of a nucleic acid contained in the probe. The sequence of the linker may not appear in the genome of the animal from which the probe non-linker nucleic acid is derived. The linker may be selected from a sequence in Table 1 (SEQ ID NOS: 20952-21063).

TABLE 1

The linker sequences

| Sequence | SEQ ID NO |
|---|---|
| GCAATGCTAGCTATTGCTTGCTATT | 20952 |
| GCAATGCTAGCTATTGCTTGCTAT | 20953 |
| GCAATGCTAGCTATTGCTTGCTA | 20954 |
| GCAATGCTAGCTATTGCTTGCT | 20955 |
| GCAATGCTAGCTATTGCTTGC | 20956 |
| GCAATGCTAGCTATTGCTTG | 20957 |
| GCAATGCTAGCTATTGCTT | 20958 |
| GCAATGCTAGCTATTGCT | 20959 |
| GCAATGCTAGCTATTGC | 20960 |
| GCAATGCTAGCTATTG | 20961 |
| GCAATGCTAGCTATT | 20962 |
| GCAATGCTAGCTAT | 20963 |
| GCAATGCTAGCTA | 20964 |
| GCAATGCTAGCT | 20965 |
| GCAATGCTAGC | 20966 |
| GCAATGCTAG | 20967 |
| GCAATGCTA | 20968 |
| GCAATGCT | 20969 |
| GCAATGC | 20970 |
| GCAATG | 20971 |
| GCAAT | 20972 |
| TATCCTACTATACGTATCACATAGCGTTCCGTATGTGGCCGGGATAGACCTAGCTTAAGC | 20973 |
| TATCCTACTATACGTATCACATAGCGTTCCGTATGTGGCCGGGATAGACCTAGCTTAAG | 20974 |
| TATCCTACTATACGTATCACATAGCGTTCCGTATGTGGCCGGGATAGACCTAGCTTAA | 20975 |
| TATCCTACTATACGTATCACATAGCGTTCCGTATGTGGCCGGGATAGACCTAGCTTA | 20976 |
| TATCCTACTATACGTATCACATAGCGTTCCGTATGTGGCCGGGATAGACCTAGCTT | 20977 |
| TATCCTACTATACGTATCACATAGCGTTCCGTATGTGGCCGGGATAGACCTAGCT | 20978 |
| TATCCTACTATACGTATCACATAGCGTTCCGTATGTGGCCGGGATAGACCTAGC | 20979 |
| TATCCTACTATACGTATCACATAGCGTTCCGTATGTGGCCGGGATAGACCTAG | 20980 |
| TATCCTACTATACGTATCACATAGCGTTCCGTATGTGGCCGGGATAGACCTA | 20981 |
| TATCCTACTATACGTATCACATAGCGTTCCGTATGTGGCCGGGATAGACCT | 20982 |
| TATCCTACTATACGTATCACATAGCGTTCCGTATGTGGCCGGGATAGACC | 20983 |
| TATCCTACTATACGTATCACATAGCGTTCCGTATGTGGCCGGGATAGAC | 20984 |
| TATCCTACTATACGTATCACATAGCGTTCCGTATGTGGCCGGGATAGA | 20985 |
| TATCCTACTATACGTATCACATAGCGTTCCGTATGTGGCCGGGATAG | 20986 |
| TATCCTACTATACGTATCACATAGCGTTCCGTATGTGGCCGGGATA | 20987 |
| TATCCTACTATACGTATCACATAGCGTTCCGTATGTGGCCGGGAT | 20988 |
| TATCCTACTATACGTATCACATAGCGTTCCGTATGTGGCCGGGA | 20989 |

TABLE 1-continued

The linker sequences

| Sequence | SEQ ID NO |
|---|---|
| TATCCTACTATACGTATCACATAGCGTTCCGTATGTGGCCGGG | 20990 |
| TATCCTACTATACGTATCACATAGCGTTCCGTATGTGGCCGG | 20991 |
| TATCCTACTATACGTATCACATAGCGTTCCGTATGTGGCCG | 20992 |
| TATCCTACTATACGTATCACATAGCGTTCCGTATGTGGCC | 20993 |
| TATCCTACTATACGTATCACATAGCGTTCCGTATGTGGC | 20994 |
| TATCCTACTATACGTATCACATAGCGTTCCGTATGTGG | 20995 |
| TATCCTACTATACGTATCACATAGCGTTCCGTATGTG | 20996 |
| TATCCTACTATACGTATCACATAGCGTTCCGTATGT | 20997 |
| TATCCTACTATACGTATCACATAGCGTTCCGTATG | 20998 |
| TATCCTACTATACGTATCACATAGCGTTCCGTAT | 20999 |
| TATCCTACTATACGTATCACATAGCGTTCCGTA | 21000 |
| TATCCTACTATACGTATCACATAGCGTTCCGT | 21001 |
| TATCCTACTATACGTATCACATAGCGTTCCG | 21002 |
| TATCCTACTATACGTATCACATAGCGTTCC | 21003 |
| TATCCTACTATACGTATCACATAGCGTTC | 21004 |
| TATCCTACTATACGTATCACATAGCGTT | 21005 |
| TATCCTACTATACGTATCACATAGCGT | 21006 |
| TATCCTACTATACGTATCACATAGCG | 21007 |
| TATCCTACTATACGTATCACATAGC | 21008 |
| TATCCTACTATACGTATCACATAG | 21009 |
| TATCCTACTATACGTATCACATA | 21010 |
| TATCCTACTATACGTATCACAT | 21011 |
| TATCCTACTATACGTATCACA | 21012 |
| TATCCTACTATACGTATCAC | 21013 |
| TATCCTACTATACGTATCA | 21014 |
| TATCCTACTATACGTATC | 21015 |
| TATCCTACTATACGTAT | 21016 |
| TATCCTACTATACGTA | 21017 |
| TATCCTACTATACGT | 21018 |
| TATCCTACTATACG | 21019 |
| TATCCTACTATAC | 21020 |
| TATCCTACTAT | 21021 |
| TATCCTACTA | 21022 |
| TATCCTACT | 21023 |
| TATCCTAC | 21024 |
| TATCCTA | 21025 |
| TATCCT | 21026 |

TABLE 1-continued

The linker sequences

| Sequence | SEQ ID NO |
|---|---|
| TATCC | 21027 |
| CGAACGATAACGGATCGTTACGATCGATAACGAACGATAA | 21028 |
| CGAACGATAACGGATCGTTACGATCGATAACGAACGATA | 21029 |
| CGAACGATAACGGATCGTTACGATCGATAACGAACGAT | 21030 |
| CGAACGATAACGGATCGTTACGATCGATAACGAACGA | 21031 |
| CGAACGATAACGGATCGTTACGATCGATAACGAACG | 21032 |
| CGAACGATAACGGATCGTTACGATCGATAACGAAC | 21033 |
| CGAACGATAACGGATCGTTACGATCGATAACGAA | 21034 |
| CGAACGATAACGGATCGTTACGATCGATAACGA | 21035 |
| CGAACGATAACGGATCGTTACGATCGATAACG | 21036 |
| CGAACGATAACGGATCGTTACGATCGATAAC | 21037 |
| CGAACGATAACGGATCGTTACGATCGATAA | 21038 |
| CGAACGATAACGGATCGTTACGATCGATA | 21039 |
| CGAACGATAACGGATCGTTACGATCGAT | 21040 |
| CGAACGATAACGGATCGTTACGATCGA | 21041 |
| CGAACGATAACGGATCGTTACGATCG | 21042 |
| CGAACGATAACGGATCGTTACGATC | 21043 |
| CGAACGATAACGGATCGTTACGAT | 21044 |
| CGAACGATAACGGATCGTTACGA | 21045 |
| CGAACGATAACGGATCGTTACG | 21046 |
| CGAACGATAACGGATCGTTAC | 21047 |
| CGAACGATAACGGATCGTTA | 21048 |
| CGAACGATAACGGATCGTT | 21049 |
| CGAACGATAACGGATCGT | 21050 |
| CGAACGATAACGGATCG | 21051 |
| CGAACGATAACGGATC | 21052 |
| CGAACGATAACGGAT | 21053 |
| CGAACGATAACGGA | 21054 |
| CGAACGATAACGG | 21055 |
| CGAACGATAACG | 21056 |
| CGAACGATAAC | 21057 |
| CGAACGATAA | 21058 |
| CGAACGATA | 21059 |
| CGAACGAT | 21060 |
| CGAACGA | 21061 |
| CGAACG | 21062 |
| CGAAC | 21063 | b. Test Probe
c. Negative Probe

The probe may be a negative probe. The negative probe may comprise a nucleic acid sequence that is not present in the biological sample. The negative probe may be complementary to a miRNA*. The sequence of the negative probe may be selected from a sequence in Table 2 (SEQ ID NOs: 20863-20925).

TABLE 2

The Negative Control Probes

| SEQUNCE | SEQ ID NO |
|---|---|
| TGGAATGTAAAGAAGTATGTA | 20863 |
| AACCCGTAGATCCGAACTTGTG | 20864 |
| TACAGTACTGTGATAACTGAAG | 20865 |
| AGCAGCATTGTACAGGGCTATGA | 20866 |
| TCAAATGCTCAGACTCCTGT | 20867 |
| AAAAGTGCTTACAGTGCAGGTAGC | 20868 |
| TAAAGTGCTGACAGTGCAGAT | 20869 |
| AGCAGCATTGTACAGGGCTATCA | 20870 |
| TACCCTGTAGATCCGAATTTGTG | 20871 |
| TACCCTGTAGAACCGAATTTGT | 20872 |
| TGGAGTGTGACAATGGTGTTTGT | 20873 |
| TTAAGGCACGCGGTGAATGCCA | 20874 |
| TCCCTGAGACCCTTTAACCTGTG | 20875 |
| TCCCTGAGACCCTAACTTGTGA | 20876 |
| CATTATTACTTTTGGTACGCG | 20877 |
| TCGTACCGTGAGTAATAATGC | 20878 |
| TCACAGTGAACCGGTCTCTTTT | 20879 |
| TCACAGTGAACCGGTCTCTTTC | 20880 |
| CTTTTTGCGGTCTGGGCTTGC | 20881 |
| CAGTGCAATGTTAAAGGGCAT | 20882 |
| CAGTGCAATGATGAAAGGGCAT | 20883 |
| TAACAGTCTACAGCCATGGTCG | 20884 |
| TTGGTCCCCTTCAACCAGCTGT | 20885 |
| TTGGTCCCCTTCAACCAGCTA | 20886 |
| TGTGACTGGTTGACCAGAGGG | 20887 |
| TATGGCTTTTTATTCCTATGTGA | 20888 |
| TATGGCTTTTCATTCCTATGTG | 20889 |
| ACTCCATTTGTTTTGATGATGGA | 20890 |
| TATTGCTTAAGAATACGCGTAG | 20891 |
| AGCTGGTGTTGTGAATC | 20892 |
| TCTACAGTGCACGTGTCT | 20893 |
| AGTGGTTTTACCCTATGGTAG | 20894 |
| TAACACTGTCTGGTAAAGATGG | 20895 |

TABLE 2-continued

The Negative Control Probes

| SEQUNCE | SEQ ID NO |
|---|---|
| TGTAGTGTTTCCTACTTTATGGA | 20896 |
| CATAAAGTAGAAAGCACTAC | 20897 |
| TGAGATGAAGCACTGTAGCTCA | 20898 |
| TACAGTATAGATGATGTACTAG | 20899 |
| GTCCAGTTTTCCCAGGAATCCCTT | 20900 |
| TGAGAACTGAATTCCATGGGTT | 20901 |
| TGAGAACTGAATTCCATAGGCT | 20902 |
| GTGTGTGGAAATGCTTCTGC | 20903 |
| TCAGTGCACTACAGAACTTTGT | 20904 |
| TCAGTGCATCACAGAACTTTGT | 20905 |
| TCTGGCTCCGTGTCTTCACTCC | 20906 |
| TCTCCCAACCCTTGTACCAGTG | 20907 |
| ACTAGACTGAAGCTCCTTGAGG | 20908 |
| TCAGTGCATGACAGAACTTGGG | 20909 |
| TTGCATAGTCACAAAAGTGA | 20910 |
| AATCATACACGGTTGACCTATT | 20911 |
| TAGGTTATCCGTGTTGCCTTCG | 20912 |
| TTAATGCTAATCGTGATAGGGG | 20913 |
| TAGCAGCACATAATGGTTTGTG | 20914 |
| TAGCAGCACATCATGGTTTACA | 20915 |
| TAGCAGCACGTAAATATTGGCG | 20916 |
| ACTGCAGTGAAGGCACTTGT | 20917 |
| CAAAGTGCTTACAGTGCAGGTAGT | 20918 |
| AACATTCAACGCTGTCGGTGAGT | 20919 |
| AACATTCATTGCTGTCGGTGGG | 20920 |
| AACATTCAACCTGTCGGTGAGT | 20921 |
| AACATTCATTGTTGTCGGTGGGTT | 20922 |
| TGGTTCTAGACTTGCCAACTA | 20923 |
| TTTGGCAATGGTAGAACTCACA | 20924 |
| TATGGCACTGGTAGAATTCACTG | 20925 | d. Positive Probe

The probe may be a positive probe. The positive probe may be complementary to a small RNA. The small RNA may be present in an animal cell, such as a mammalian cell. The small RNA may be less than 200 nucleotides in length. The small RNA may be a ribosomal RNA. The sequence of the nucleic acid may be selected from a sequence in Table 3 (SEQ ID NOS: 20926-20937).

TABLE 3

The Positive Control Probes

| SEQUNCE | SEQ ID NO |
|---|---|
| TCAGAACGTGACAATCAGCACTAGCTATTGCTTGCTATT | 20926 |
| CAGTGAAGCAATGGCAATACTAGCTATTGCTTGCTATT | 20927 |
| TGCATCAGCGATCTTGGTGGTTAGCTATTGCTTGCTATT | 20928 |
| CTTCACTTACTGTCAGTAGCATAGCTATTGCTTGCTATT | 20929 |
| GAATTTGCGTGTCATCCTTGCGTAGCTATTGCTTGCTATT | 20930 |
| GAACCACCTCAGTAGTGTCTGTAGCTATTGCTTGCTATT | 20931 |
| GGTCAGAGCGCTGCGGTGATGTAGCTATTGCTTGCTATT | 20932 |
| AGACCTTCATGTTCAGTCAGCTAGCTATTGCTTGCTATT | 20933 |
| GCTAGCGCTGCGTTCTTCATCTAGCTATTGCTTGCTATT | 20934 |
| GCTTCCGAGATCAGACGAGATCTAGCTATTGCTTGCTATT | 20935 |
| TCTGTATCGTTCCAATTTAATGCTAGCTATTGCTTGCTATT | 20936 |
| GCGTGTCATCCTTGCGAATGCTAGCTATTGCTTGCTATT | 20937 | e. Spike Probe

The probe may be a spike probe. The spike probe may comprise a sequence that is not complementary to 20-100 consecutive nucleotides (e.g., 60) in a genome. The genome may be an animal genome or viral genome. The animal may be human, mouse or rat. The sequence of the spike probe may be selected from a sequence listed in Table 4 (SEQ ID NOS: 20938-20951).

TABLE 4

The Spikes

| SEQUNCE | SEQ ID NO |
|---|---|
| TATTATGCGCGTAGCGTACCGAATGCTAGCTATTGCTTGCTATT | 20938 |
| CGCGCATAATATCGGTACGCTAATGCTAGCTATTGCTTGCTATT | 20939 |
| CGAATCGCGTATATTATGCGCGATGCTAGCTATTGCTTGCTATT | 20940 |
| TTACGCGTACCTATATCGACCCATGCTAGCTATTGCTTGCTATT | 20941 |
| CGTCGACTATCTATATCGACCCATGCTAGCTATTGCTTGCTATT | 20942 |
| TATCGCGAACTCGCCCTATAACATGCTAGCTATTGCTTGCTATT | 20943 |
| ATATAAGTTCGTATAACTATCGATGCTAGCTATTGCTTGCTATT | 20944 |
| CGATTAGTATACGAACTTATATATGCTAGCTATTGCTTGCTATT | 20945 |
| CGTTTCGTACGTCGTCGATTCGATGCTAGCTATTGCTTGCTATT | 20946 |
| CGAATCGACGACGCGCATAATAATGCTAGCTATTGCTTGCTATT | 20947 |
| TTAGTATCGAATACTAATCGATATGCTAGCTATTGCTTGCTATT | 20948 |
| CGATTAGTATACGAACTTATATATGCTAGCTATTGCTTGCTATT | 20949 |
| ATATAAGTTCGTATAACTATCGATGCTAGCTATTGCTTGCTATT | 20950 |
| TTAGTATCGAATTCGATACTAAATGCTAGCTATTGCTTGCTATT | 20951 |

3. Biochip

A biochip is also provided. The biochip may comprise a solid substrate comprising an attached probe or plurality of probes described herein. The probes may be capable of hybridizing to a target sequence under stringent hybridization conditions. The probes may be attached at spatially defined address on the substrate. More than one probe per target sequence may be used, with either overlapping probes or probes to different sections of a particular target sequence. The probes may be capable of hybridizing to target sequences associated with a single disorder. The biochip may comprise a negative probe, a positive probe, a spike probe, a test probe, or a combination thereof.

The probes may be attached to the biochip in a wide variety of ways, as will be appreciated by those in the art. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, Teflon J, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as a flexible foam, including closed cell foams made of particular plastics.

The biochip and the probe may be derivatized with chemical functional groups for subsequent attachment of the two. For example, the biochip or probe may be derivatized with a chemical functional group including, but not limited to, aldehyde groups, amine groups, amino groups, carboxyl groups, epoxy, oxo groups or thiol groups. Using these functional groups, the probes may be attached using functional groups on the probes either directly or indirectly using a linkers. The probes may be attached to the solid support by either the 5'terminus, 3'terminus, or via an internal nucleotide. The probe may comprise a functional group, which may be a 5'amino modifier C12 or a 3'amino modifier C6.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

4. Method for Detecting a Target Nucleic Acid

A method is provided herein for detecting a target nucleic acid. FIG. 5 is a schematic representation of the method. The method may comprise using a probe (hereafter, "the probe") to specifically detect and distinguish a target nucleic acid (hereafter, "the target nucleic acid") from a substantially identical nucleic acid (hereafter, "the sibling nucleic acid"), wherein the sibling nucleic acid may differ from the target nucleic acid at a site that may include as few as one nucleotide (hereafter, "the variant site").

The probe, the target nucleic acid, and the sibling nucleic acid may each comprise a first portion and a second portion. The first portions of the target nucleic acid, the sibling nucleic acid, and the probe may all be located on the 5' end of each respective nucleic acid, or they may all be located on the 3' end of each respective nucleic acid. Conversely, the second portion of the target nucleic acid, the sibling nucleic acid, and the probe may all be located on the 3' end of each respective nucleic acid, or they may all be on the 5' end of each respective nucleic acid. The methods provided herein are based upon the strength of hybridization between the two portions of the probe and the corresponding two portions of the target nucleic acid, and between the two portions of the probe and the corresponding two portions of the sibling nucleic acid.

a. Target Nucleic Acid and Sibling Nucleic Acid

The first portion of the target nucleic acid may be substantially identical in sequence to the first portion of the sibling nucleic acid, differing at the variant site by as few as one nucleotide. The second portion of the target nucleic acid may be identical in sequence to the second portion of the sibling nucleic acid.

b. Interaction Between the Probe and the Target Nucleic Acid

The first portion of the probe and the first portion of the target nucleic acid may be complementary. The second portion of the probe and the second portion of the target nucleic acid may also be substantially complementary.

c. Interaction Between the Probe and the Sibling Nucleic Acid

The first portion of the probe and the first portion of the sibling nucleic acid may be substantially complementary. The second portion of the probe and the second portion of the sibling nucleic acid may be substantially complementary.

d. Distinguishing the Target Nucleic Acid from the Sibling Nucleic Acid Using the Probe While not being bound by theory, the substantial complementarity between the second portion of the probe and the second portion of the sibling nucleic acid may sensitize the probe to a mismatch between the first portion of the probe and the first portion of the sibling nucleic acid causing an overall effect of less efficient hybridization between the probe and the sibling nucleic acid. In contrast, the substantial complementarity between the second portion of the probe and the second portion of the target nucleic acid may cause the first portion of the probe to more efficiently bind to the complementary first portion of the target nucleic acid. The substantial complementarity between the first and second portions of the probe and sibling nucleic acid may result in an overall weaker hybridization between the probe and the sibling target nucleic acid compared to the hybridization between the probe and the target nucleic acid. The probe may thus specifically detect the target nucleic acid (of which the first portion is complementary to the first portion of the probe) and distinguish the target nucleic acid from the sibling nucleic acid. A method described herein may allow specific detection of the target nucleic acid in a diverse background of other substantially identical nucleic acids ranging in concentration from low to high.

e. Target Nucleic Acid

A method is provided herein for detecting a target nucleic acid in a sample, wherein the target nucleic acid may comprise a first portion and a second portion. The target nucleic acid may comprise an adaptor sequence. Adaptor sequences are well known in the art to be used for detecting and amplifying nucleic acids, such as in polymerase chain reactions.

f. Sibling Nucleic Acid

A method is provided herein for detecting a target nucleic acid, wherein the target nucleic acid may be distinguished from a sibling nucleic acid. The sibling nucleic acid may comprise a first portion and a second portion. The second portion of the sibling nucleic acid may be identical to the second portion of the target nucleic acid. The first portion of the sibling nucleic acid may be substantially identical to the first portion of the target nucleic acid. The first portion of the sibling nucleic acid may also comprise a variant site.

g. Variant Site

The first portion of the target nucleic acid may comprise a variant site. The first portion of the sibling nucleic acid may also comprise a variant site. The variant site may differ between the target nucleic acid and the sibling nucleic acid. The variant site may also differ among substantially identical sibling nucleic acids. The variant site may comprise by as few as one nucleotide. The variant site of the target nucleic acid may differ from the variant site of the nucleic acid by as few as one nucleotide.

(1) Gene Families

The target nucleic acid and the sibling nucleic acid may be members of the same gene family. The gene family may comprise a plurality of genes. The genes may be evolutionarily related (i.e., share a common ancestral gene). The genes may share common sequence motifs and structures. The genes may also be substantially identical in sequence. The sequences may comprise a variant site, which may differ among the genes of a gene family.

The genes may be RNA genes, which may encode ribozymes, rRNA, tRNAs, or miRNAs. For example, the human genes encoding miRNAs Let-7a and Let-7c differ in sequence by one nucleotide.

The gene family may also be a collection of genes encoding at least one polypeptide domain whose amino acid sequences have at least 25% sequence identity over a comparison window of at least 20 amino acids. Such domains may be related through common ancestry as a result of gene duplication or evolution. Many polypeptide domains are known in the art including, for example, the EGF domain, the immunoglobulin domain, the fibronectin type III domain, the cadherin-like domain, death effector domains (DED).

The gene family may encode polypeptides sharing at least one highly conserved region. Two polypeptides share a "highly conserved region" if the polypeptides have a sequence identity of at least 60% over a comparison window of five amino acids, or if they share a sequence identity of at least 50% over a comparison window of ten amino acids.

(2) Polymorphisms

The variant site may comprise a polymorphism. "Polymorphism" as used herein may mean the occurrence of two or more genetically determined alternative sequences or alleles in a population. The polymorphism may comprise one nucleotide (i.e., comprise a single nucleotide polymorphism, or SNP), which may be an A, C, G, T, or U. The polymorphism may also comprise a small insertion or deletion. The polymorphism may be associated with or cause a disease or condition. The polymorphism may also be associated with the response of an individual to an agent such as a pharmacotherapeutic. The polymorphism may occur in a coding or noncoding region of a gene, or in an intergenic region between genes. The polymorphism may be a mutation. The mutation may be a nonsynonymous (i.e., silent), or synonymous (e.g., missense, asense, or nonsense) mutation. The mutation may also result in a change in the splicing or regulation of a gene.

A polymorphic marker or site is the locus at which divergence occurs. Markers may have at least two alleles, each occurring at frequency of greater than 1%, and may occur at a frequency greater than 10% or 20% of a selected population. A polymorphism may comprise one or more base changes, an insertion, a repeat, or a deletion. A polymorphic locus may be as small as one base pair. Polymorphic markers may include restriction fragment length polymorphisms, variable number of tandem repeats (VNTRs), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wild type form. Diploid organisms may be homozygous or heterozygous for allelic forms. A diallelic polymorphism has two forms. A triallelic polymorphism has three forms. Single nucleotide polymorphisms (SNPs) may be included in polymorphisms.

Single nucleotide polymorphism (SNPs) are positions at which two alternative bases occur at appreciable frequency (>1%) in the human population, and are the most common type of human genetic variation. The site may be preceded by and followed by highly conserved sequences of the allele (e.g., sequences that vary in less than 1/100 or 1/1000 members of the populations). A single nucleotide polymorphism may arise due to substitution of one nucleotide for another at the polymorphic site. A transition is the replacement of one purine by another purine or one pyrimidine by another pyrimidine. A transversion is the replacement of a purine by a pyrimidine or vice versa. Single nucleotide polymorphisms may also arise from a deletion of a nucleotide or an insertion of a nucleotide relative to a reference allele.

h. Probe

A method for detecting a target nucleic acid is provided herein wherein a probe specifically detects a target nucleic acid. The probe may comprise a first and second portion. The first portion of the probe may be complementary to the first portion of a target nucleic aid. The second portion of the probe may be substantially complementary to the second portion of the target nucleic acid. The probe may comprise 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, 50, 55, 60, 65, 70, 75, 80, 85, 90, 95, or 100 nucleotides that are complementary to the target nucleic acid. The probe may also be substantially complementary to the sibling nucleic acid. The probe may comprise 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, 50, 55, 60, 65, 70, 75, 80, 85, 90, 95, or 100 nucleotides that are complementary to the sibling nucleic acid.

The probe may have a melting temperature of 68-70° C. The probe may be used in an amplifying reaction. The reaction may be PCR. The PCR reaction may comprise a forward primer, a reverse primer, and the probe. The PCR reaction may comprise the probe and a reverse primer bound to the target nucleic acid in a complex wherein the 5' end of the probe may be located 5, 6, 7, 8, 9, 10 or 11 nucleotides upstream relative to the 3' end of the reverse primer.

The probe may also comprise a label. The probe may also comprise more than 2 nucleic acids. The probe may also comprise a minor groove binder.

(1) Detection Site

The first portion of the probe may comprise a detection site. The detection site may comprise one nucleotide. The detection site may also comprise a plurality of nucleotides. The detection site may be complementary to the variant site of a target nucleic acid. The detection site may also be non-complementary to the variant site of the sibling nucleic. The detection site may be located at either the 5' end or the 3' end of the probe. For example, the detection site may be 2, 3, 4, 5, 6, 7 or 8 bases from the 5' end of the probe, or the detection site may be 2, 3, 4, 5, 6, 7, or 8 bases from the 3' end of the probe. The detection site may be 8-10 nucleotides complementary to the target nucleic acid.

(2) Sensitizing Site

The second portion of the probe may comprise a sensitizing site. The sensitizing site may be noncomplementary to a target nucleic acid. The sensitizing site may also be non-complementary to the sibling nucleic acid. The sensitizing site may be distal to the detection site. The sensitizing site may sensitize the probe to an additional mismatch between the probe and the first portion of the sibling nucleic acid causing an overall effect of less efficient hybridization between the probe and the sibling nucleic acid. In contrast, the sensitizing site of the probe may cause the first portion of the probe to efficiently bind to the complementary first portion of the target nucleic acid for an overall effect of more efficient hybridization between the probe and the target nucleic acid. The sensitizing site may be located at any site position of the probe including the 5' end, the 3' end or anywhere in between the ends of the probe, but distal to the detection site. The sensitizing site may comprise one nucleotide. The sensitizing site may also comprise a plurality of nucleotides. The sensitizing site may comprise 1-20 nucleotides. The sensitizing site may also comprise a poly(A) binding region. The poly(A) binding region may be complementary to the poly(A) of a cDNA.

i. Background Nucleic Acid

Also provided herein is a method of specifically detecting a target nucleic acid and distinguishing the target nucleic acid from a background nucleic acid. The background nucleic acid may comprise a plurality of nucleic acids. The background nucleic acid may comprise a sibling nucleic acid. The background nucleic acid may also comprise a diversity of non-target nucleic acids and non-sibling nucleic acids. The background nucleic acid may be neither identical nor substantially identical to the target nucleic acid.

5. Methods of Making a Target Nucleic Acid

Methods of making a target nucleic acid are also provided. The target nucleic acid may comprise an adaptor sequence that is located in the second portion of the target nucleic acid. The adaptor sequence may be used to generate noncomplementarity between the second portion of a target nucleic acid and the second portion of a probe. The adaptor sequence may comprise a sequence that is non-complementary to the sensitizing site.

The adaptor sequence may comprise 12-30 nucleotides. The adaptor sequence may comprise a synthetic sequence. The adaptor sequence may also comprise a sequence that is nonidentical to any sequence in the genome of the animal from which the target nucleic acid is isolated. The adaptor sequence may be ligated to the target nucleic acid. The adaptor sequence may be added to the target nucleic acid by PCR. The PCR may comprise an adaptor primer comprising a sequence complementary to the adaptor sequence. The adaptor sequence may also comprise a poly(A) sequence.

a. Method of Generating a Target Nucleic Acid from RNA (1) RNA Extraction/Polyadenylation The target nucleic acid may be RNA. Methods for isolating and amplifying the target sequences of RNA include total RNA extraction, a polyadenylation reaction, and a reverse transcription (RT) reaction. The target RNA may be mRNA, tRNA, shRNA, siRNA, Piwi-interacting RNA, pri-miRNA, pre-miRNA, miRNA, or anti-miRNA. The RNA may be polyadenylated. Polyadenylation may be generated by a poly (A) polymerase. Polyadenylation may also be generated by using a poly(A) tailing kit. Polyadenylation may also be by the method of Shi and Chiang (Biotechniques, 2005; 39(4): 519-25), the contents of which are incorporated herein by reference. Polyadenylation may add 8, 9, 10, 11, 12, 13, 14, 15, 16, 17, 18, 19, 20, 30, 40, 50, 60, 70, 80, 90, 100, 110, 120, 130, 140, 150, 160, 170, 180, 190, 200, 210, 220, 230, 240, or 250 adenosines to the target nucleic acid.

(2) Reverse Transcription

Target sequences of a cDNA may be generated by reverse transcription of the target RNA. Methods for generating cDNA may be reverse transcribing polyadenylated RNA or alternatively, RNA with a ligated adaptor sequence. The cDNA may be synthesized according to methods outlined in U.S. patent Ser. No. 11/384,049, the contents of which are incorporated herein by reference.

(a) Reverse Transcription Using Adaptor Sequence Ligated to RNA

The RNA may be ligated to an adapter sequence prior to reverse transcription. A ligation reaction may be performed by T4 RNA ligase to ligate an adaptor sequence at the 3' end of the RNA. Reverse transcription (RT) reaction may then be performed using a primer comprising a sequence that is complementary to the 3' end of the adaptor sequence.

(b) Reverse Transcription Using Polyadenylated Sequence Ligated to RNA

Polyadenylated RNA may be used in a reverse transcription (RT) reaction using a poly(T) primer comprising a 5' adaptor sequence. The poly(T) sequence may comprise 8, 9, 10, 11, 12, 13, or 14 consecutive thymines. The reverse transcription primer may comprise one of the following sequences:

```
5' GCGAGCACAGAATTAATACGACTCACTACCCGTTTTTTTTTTT
VN 3'

5'-GCGAGCACAGAATTAATACGACTCACTACGCGTTTTTTTTTTVN-
3'

5'-GCGAGCACAGAATTAATACGACTCACTATAGGTTTTTTTTTTVN
-3'
where V = a mixture of A, C and G and N = a
mixture of all 4 nucleotides.
```

(3) RT-PCR of RNA

The reverse transcript of the RNA may be amplified by real time PCR, using a specific forward primer comprising at least 15 nucleic acids complementary to the target nucleic acid and a 5' tail sequence; a reverse primer that is complementary to the 3' end of the adaptor sequence; and a probe comprising at least 8 nucleic acids complementary to the target nucleic acid. The probe may be partially complementary to the 5' end of the adaptor sequence.

b. PCR of Target Nucleic Acids

Methods of amplifying target nucleic acids are described herein. The amplification may be by a method comprising PCR. The first cycles of the PCR reaction may have an annealing temp of 56° C., 57° C., 58° C., 59° C., or 60° C. The first cycles may comprise 1-10 cycles. The remaining cycles of the PCR reaction may be 60° C. The remaining cycles may comprise 2-40 cycles. The annealing temperature may cause the PCR to be more sensitive. The PCR may generate longer products that can serve as higher stringency PCR templates.

(1) Forward Primer

The PCR reaction may comprise a forward primer. The forward primer may comprise 15, 16, 17, 18, 19, 20, or 21 nucleotides identical to the target nucleic acid.

The 3' end of the forward primer may be sensitive to differences in sequence between a target nucleic acid and a sibling nucleic acid.

The forward primer may also comprise a 5' overhanging tail. The 5' tail may increase the melting temperature of the forward primer. The sequence of the 5' tail may comprise a sequence that is non-identical to the genome of the animal from which the target nucleic acid is isolated. The sequence of the 5' tail may also be synthetic. The 5' tail may comprise 8, 9, 10, 11, 12, 13, 14, 15, or 16 nucleotides. The 5' overhanging tail may comprise the sequence 5'-ACACTCCAGCTGGG-3'. The 5' overhanging tail may also comprise the sequence 5'-CAGTCATTTGGG-3'. The forward primer may comprise a sequence corresponding to the sequence of a SEQ ID NO in the "FD-P" column of Table 7.

(2) Reverse Primer

The PCR reaction may comprise a reverse primer. The reverse primer may be complementary to a target nucleic acid. The reverse primer may also comprise a sequence complementary to an adaptor sequence. The sequence complementary to an adaptor sequence may comprise 12-24 nucleotides. The reverse primer may comprise the sequence

```
5'-GCGAGCACAGAATTAATACGAC-3'.
```

6. Expression Analysis of Diseases and Conditions

Also provided herein is a method of identifying a target nucleic acid associated with a disease or pathological condition. The target nucleic acid may comprise a variant site. The variant site may be associated with a disease, pathological condition, or trait. The trait may be any identifiable state, such as color, height, size, or predisposition. The method may comprise contacting the target nucleic acid with a probe. The level of the probe binding to the target nucleic acid compared to a control may be indicative of a disease, pathological condition, or trait.

For example, detecting the level (or expression level) of a target nucleic acid compared to a control may provide a high-resolution, high-sensitivity dataset, which may be used in the areas of diagnostics, prognostics, therapeutics, drug development, pharmacogenetics, biosensor development, and other related areas.

An expression profile generated by the current method may be a "fingerprint" of the state of the sample with respect to a number of target nucleic acids. While two states may have any particular target nucleic acid similarly expressed, the evaluation of a number of target nucleic acids simultaneously allows the generation of a gene expression profile that is characteristic of the state of the cell. That is, normal tissue may be distinguished from diseased tissue. By comparing expression profiles of tissue in known different disease states, information regarding which target nucleic acids are associated in each of these states may be obtained. Then, diagnosis may be performed or confirmed to determine whether a tissue sample has the expression profile of normal or disease tissue. This may provide for molecular diagnosis of related conditions.

The expression level of a disease-associated target nucleic acid is information in a number of ways. For example, a differential expression of a disease-associated target nucleic acid compared to a control may be used as a diagnostic that a patient suffers from the disease. Expression levels of a disease-associated target nucleic acid may also be used to monitor the treatment and disease state of a patient. Furthermore, expression levels of a disease-associated target nucleic acid may allow the screening of drug candidates for altering a particular expression profile or suppressing an expression profile associated with disease.

A target nucleic acid may be detected and levels of the target nucleic acid measured by contacting a sample comprising the target nucleic acid with a probe sufficiently complementary to the target nucleic acid and detecting hybridization to the probe above control levels.

The target nucleic acid may be detected by immobilizing the target nucleic acid to be examined on a solid support such as nylon membranes and hybridizing a labeled probe with the sample. The target nucleic acid may be detected by immobilizing a labeled probe to a solid support and hybridizing a sample comprising a labeled target nucleic acid. Following washing to remove the non-specific hybridization, the label may be detected.

The target nucleic acid may be detected in a biological sample according to the methods outlined in U.S. patent Ser. No. 11/384,049, the contents of which are incorporated herein by reference.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

a. Diagnostic

A method of diagnosis is also provided. The method may comprise detecting a differential expression level of disease-associated target nucleic acid in a biological sample. The sample may be derived from a patient. Diagnosis of a disease state in a patient may allow for prognosis and selection of therapeutic strategy. Further, the developmental stage of cells may be classified by determining temporarily expressed disease-associated target nucleic acids.

In situ hybridization of labeled probes to tissue arrays may be performed. When comparing the fingerprints between an individual and a standard, the skilled artisan may make a diagnosis, a prognosis, or a prediction based on the findings. It is further understood that the genes, which indicate the diagnosis, may differ from those, which indicate the prognosis. In addition, molecular profiling of the condition of the cells may lead to distinctions between responsive or refractory conditions or may be predictive of outcomes. For example, the method of diagnosing may comprise detecting differential levels of cancer-associated target nucleic acids in a biological sample. The source of cancer-associated target nucleic acids may be from a cancer cell characterized by unregulated cell-growth. A cancer cell may include cells arising from breast cancer, colon cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma, and brain cancer.

b. Genotyping

Also provided herein is a method for genotyping using a probe described herein to detect a polymorphism such as a SNP. "Genotyping" used herein may be the determination of the genetic information an individual carries at one or more positions in the genome. For example, genotyping may comprise determining which allele or alleles an individual carries for a single SNP or determining which allele or alleles an individual carries for a plurality of SNPs. A genotype may be the identity of the alleles present in an individual at one or more polymorphic sites.

(1) Human Diseases and Conditions

Genotyping may be for measuring the predisposition of a human for a disease or condition. For example, genotyping may be used as described in U.S. Pat. No. 7,127,355, the contents of which are incorporated herein by reference. Genotyping may also be used to predict the response of an individual to a pharmacotherapeutic or other treatment.

(2) Viral RNA

Genotyping may also be for detecting the presence of a mutation in a viral genome such as HIV, Hepatitis B Virus, or Human papilloma virus. Examples of such genotyping may be found in U.S. Pat. Nos. 6,797,464 and 6,653,081, and U.S. Patent Pub. Nos. 20050112554 and 2005014379, the contents of which are incorporated herein by reference.

(3) Bacterial Pathogenesis

Genotyping may also be for detecting bacterial strains and mutations, such bacterial antibiotic resistance. For example, genotyping may be as described in U.S. Pat. No. 6,913,753, the contents of which are described herein by reference.

7. Drug Screening

A method of screening therapeutics is also provided. The method comprises contacting a pathological cell capable of expressing a disease related nucleic acid with a candidate therapeutic and evaluating the effect of a drug candidate on the expression profile of the disease associated target nucleic acid. Having identified the differentially expressed target nucleic acid, a variety of assays maybe executed. Test compounds may be screened for the ability to modulate gene expression of the disease associated nucleic acid. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated nucleic acid. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated nucleic acid or to modulate the activity thereof. The combinatorial library may be a collection of diverse chemical compounds generated by either chemical synthesis or biological synthesis by combining a number of chemical building blocks such as reagents.

Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

8. Gene Silencing

A method of reducing expression of a target gene in a cell, tissue or organ is also provided. Expression of the target gene may be reduced by expressing a nucleic acid described herein that comprises a sequence substantially complementary to one or more binding sites of the target mRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target mRNA, which may lead to activation of RISC-mediated gene silencing. An example for a study employing over-expression of miRNA is Yekta et al 2004, Science 304-594, which is incorporated herein by reference. One of ordinary skill in the art will recognize that the nucleic acids described herein may also be used to inhibit expression of target genes or inhibit activity of miRNAs using antisense methods well known in the art, as well as RNAi methods described in U.S. Pat. Nos. 6,506,559 and 6,573,099, which are incorporated by reference.

The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated by reference.

9. Gene Enhancement

A method of increasing expression of a target nucleic acid in a cell, tissue or organ is also provided. Expression of the target nucleic acid may be increased by expressing a nucleic acid described herein that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target nucleic acid may also be increased by expressing a nucleic acid that is substantially complementary to a portion of the binding site in the target gene, such that binding of the nucleic acid to the binding site may prevent miRNA binding.

10. Therapeutic

A method of modulating a disease or disorder associated with developmental dysfunctions is also provided. The disease or disorder may be cancer, such as prostate or liver cancer. In general, the nucleic acid molecules described herein may be used as a modulator of the expression of genes which are at least partially complementary to said nucleic acid. Further, miRNA molecules may act as target for therapeutic screening procedures, e.g. inhibition or activation of miRNA molecules might modulate a cellular differentiation process, e.g. proliferation or apoptosis. Furthermore, existing miRNA molecules may be used as starting materials for the manufacture of sequence-modified miRNA molecules, in order to modify the target-specificity thereof, e.g. an oncogene, a multidrug-resistance gene or another therapeutic target gene. Further, miRNA molecules can be modified, in order that they are processed and then generated as double-stranded siRNAs which are again directed against therapeutically relevant targets. Furthermore, miRNA molecules may be used for tissue reprogramming procedures, e.g. a differentiated cell line might be transformed by expression of miRNA molecules into a different cell type or a stem cell.

11. LUMINEX® Method of Detection

The method of detecting target nucleic acids or miRNAs includes a number of steps discussed herein. Total RNA is extracted from tissue. The short RNAs fraction is enriched using a YM 100 column. The small RNA fraction may be labeled utilizing different methods (e.g., biotinylation). In parallel, miRNA antisense DNA or locked nucleic acid (LNA) probes with an amine-modification may be coupled to carboxylated color-coded LUMINEX® microspheres (beads) using EDC to make coupled bead mixtures, with each mixture containing as many as 100 different miRNA probes, each probe coupled to a bead with a different specific spectral signature or color. Beads may be prepared as a set of 100 distinct kinds that can be differentially detected by the LUMINEX® analyzer. The labeled miRNAs may then hybridized to mixtures of probe-bound color beads. The hybridized miRNA-coupled bead mixture may be treated with streptavidin-R-phycoerythrin dye. The reaction may be analyzed using the LUMINEX® analyzer. Lasers excite the internal dyes that identify each microsphere particle, as well as the reporter dye that is bound to the miRNA. The median intensity of the dye on each bead may be proportional to expression of the specific RNA in the tissue.

MiRNAs or probes or target nucleic acids may be labeled as follows:

12. Direct labeling a. Chemical Labeling

Examples include ULS technology, using part of a PerkinElmer Micromax kit for biotinylation of miRNA. This method labels miRNAs with biotins along their lengths, and was found to be reproducible and robust.

b. Kreatech Chemical Labeling Kit

This method labels miRNA or probes or target nucleic acids with biotin with a similar technology as PerkinElmer, but was shown to be somewhat less sensitive.

c. Enzymatic End Labeling

Examples include ligation of dinucleotides with a biotin entity (pCU-bio).

13. Signal Amplification a. TSA

Tyramide signal amplification (TSA) amplifies the number of biotins in site, starting from one biotin to which a Streptavidin-horse radish peroxidase (HRP) conjugate is bound. The Tyramide biotin substrate is processed by the HRP to produce a non soluble biotin that is precipitated in site, creating a cluster of biotins on the appropriate microsphere.

b. Genisphere

The method utilizes a 3DNA system of branched DNA that has a large number of bound biotin molecules, and is useful for detecting miRNAs when only low amounts of starting material are available.

14. Transcription a. Direct Transcript

This method generates transcripts labeled with biotin for linear amplification of the RNA. This method may generated transcripted labeled with biotin from target nucleic acids.

b. SenseAmp Plus

This method uses amplification of miRNA using a Genisphere kit. Multiple aspects are described herein, illustrated by the following non-limiting examples.

15. Possible Applications

Small RNA proofing using the LUMINEX® technology is a fast and reliable technology and may be applied in high throughput manner to many samples at once. This system is highly sensitive and specific, thus may be applied to a large range of validations and profiling of miRNA or target nucleic acids for basic biological research, diagnostics and therapeutics. The high reproducibility of the technology makes it highly reliable.

The methods provided herein may be used for validation of newly predicted miRNA in the cell. It may also be used for validation and expression profiling of other short RNAs. It may also be used for validation of expression level of transfected siRNA (inhibitory RNA) expression in cells in therapeutic or research applications. It may also be used for expression proofing of miRNA in cells, tissues and body fluids for: discovery of miRNA differentiation in cancer and normal cells, early detection of cancer cells in body fluids and biopsies, prognosis of cancer stage, prediction of potential survival and response to treatments, determining tissue origin of metastasis carcinoma, for assigning appropriate anti-cancerous treatment, or for screening for potential therapeutic compounds. It may also be used for profiling miRNA in embryonic samples for the study of tissue development and differentiation.

16. Kits

A kit is also provided and may comprise a nucleic acid described herein together with any or all of the following: assay reagents, buffers, probes and/or primers, and sterile saline or another pharmaceutically acceptable emulsion and suspension base. In addition, the kits may include instructional materials containing directions (e.g., protocols) for the practice of the methods described herein.

For example, the kit may be a kit for the amplification, detection, identification or quantification of a target nucleic acid sequence. The kit may comprise a poly(T) primer, a forward primer, a reverse primer, and a probe.

EXAMPLES

Example 1

Methods of Generating a Target Nucleic Acid

A method for generating a target nucleic acid from miRNA is described below. Total RNA was isolated and extracted from cultured CHO cells. An adaptor sequence was generated using polyadenylation or an adaptor sequence was ligated to an adapter sequence prior to reverse transcription. A ligation reaction was then performed by T4 RNA ligase to ligate an adaptor sequence at the 3' end of the RNA.

Reverse transcription (RT) reaction was performed using a primer comprising a sequence that is complementary to the 3' end of the adaptor sequence. The reverse transcription primer (oligodT primer) was chosen from one of the following sequences:

```
                                          (SEQ ID NO 20836)
5'-GCGAGCACAGAATTAATACGACTCACTACCCGTTTTTTTTTTTVN-
3'

(SEQ ID NO 20837)
5'-GCGAGCACAGAATTAATACGACTCACTATCGGTTTTTTTTTTTVN-
3'

(SEQ ID NO 20853)
5'-GCGAGCACAGAATTAATACGACTCACTACCCGTTTTTTTTTTVN-3'

(SEQ ID NO 20854)
5'-GCGAGCACAGAATTAATACGACTCACTATCCGTTTTTTTTTTTVN-
3'

(SEQ ID NO 20855)
5'-GCGAGCACAGAATTAATACGACTCACTATCCCTTTTTTTTTTTVN-
3'

(SEQ ID NO 20856)
5'-GCGAGCACAGAATTAATACGACTCACTATCCGTTTTTATTTTTVN-
3'

(SEQ ID NO 20857)
5'-GCGAGCACAGAATTAATACGACTCACTATAGGTTTTTTTTTTTVN-
3'

(SEQ ID NO 20858)
5'-GCGAGCACAGAATTAATACGACTCACTATCCGATTTTTTTTTTVN-
3'
``` where V=a mixture of A, C and G and N=a mixture of all 4 nucleotides. The reverse transcript of the RNA was amplified by real time PCR reaction, using a specific forward primer that is complementary to the target nucleic acid and a 5' tail sequence. The forward primers was chosen from the sequences of 5' CAGTCATTTGGG 3' (SEQ ID NO 20839) or the corresponding to the sequence of a SEQ ID NO in the "FD-P" column of Table 7.

A reverse primer was also chosen that is complementary to the 5' end of the adaptor sequence. The reverse primer was 5'-GCGAGCACAGAATTAATACGAC-3' (SEQ ID NO 20859). The probe was partially complementary to the 3' end of the adaptor sequence.

PCR was then performed. The first cycles of the PCR reaction had an annealing temp of 58° C. The first cycles are 5 cycles. The remaining cycles of the PCR reaction was 60° C. The remaining cycles was 35 cycles. A target nucleic acid was generated from the methods describe above with the sequence 5'-TGAGGTAGTAGGTTGTATAGTT-3' (SEQ ID No: 20840)

Example 2

Probes for Detecting a Target Nucleic Acid

Probes for detecting a target nucleic acid are described herein. The probe to a polyadenylated cDNA was generated with the sequence 5'-CCGTTTTTTTTTTTT-3' (SEQ ID No: 20845). This sequence was then followed by a sequence complementary to target binding region to ensure the probe was partially complementary to the 3' end of the adaptor sequence of the target nucleic acid. The synthetic target binding region had three variations, with each variation shifted by one nucleotide relative to the target nucleic acid.

The three variations of probes were used that were capable of binding to a target nucleic acid comprising the sequence 5'-TGAGGTAGTAGGTTGTATAGTT-3' (SEQ ID No: 20840) comprised the following sequences:

```
Probe_v1
5'-CCGTTTTTTTTTTTTAACTATAC-3'    (SEQ ID No: 20846)

Probe_v2
5'-CCGTTTTTTTTTTTTACTATACA-3'    (SEQ ID No: 20847)

Probe_v3
5'-CCGTTTTTTTTTTTCTATACAA-3'     (SEQ ID No: 20848)
```

The sequence of the target binding region cannot have a 3' terminal 'A.' For example, the three variations of probes capable of binding to a target nucleic acid comprising the sequence 5'-TGATTGGTACGTCTGTGGGTAGA-3' (SEQ ID No: 20849) comprise the following sequences:

```
Probe_v1
5'-CCGTTTTTTTTTTTTCTACCCAC-3'    (SEQ ID No: 20850)

Probe_v2
5'-CCGTTTTTTTTTTTTACCCACAG-3'    (SEQ ID No: 20851)

Probe_v3
5'-CCGTTTTTTTTTTTCCCACAGA-3'     (SEQ ID No: 20852)
```

The probes also could be designed with sequence corresponding to a sequence of a SEQ ID NO in the "Probe1," "Probe2," or "Probe3" columns of Table 7.

Example 3

Detecting a Single Nucleotide Difference: Let-7a Versus Let-7d

Members of the human Let-7 family of miRNAs that only differ by one nucleotide were detected using the method described in Example 1. The sequences of two members of this family were as follows:

```
                                         (SEQ ID NO: 20840)
hsa-Let-7a   5'-UGAGGUAGUAGGUUGUAUAGUU-3'

(SEQ ID NO: 20841)
hsa-Let-7c   5'-UGAGGUAGUAGGUUGUAUGGUU-3'

(SEQ ID NO: 20842)
hsa-Let-7d   5'-AGAGGUAGUAGGUUGCAUAGU-3'
```

A minor groove binder (MGB) probe with (i) a 5'-CCG sequence that had no mismatch to the adaptor sequence of the reverse transcription primer as described above (i.e., 0 mismatch), and (ii) that was perfectly-matched to Let-7a at its 3' end was used in real time PCR (FIG. 3). Quantification of the 0 mismatch probe during real time PCR revealed that Let-7a miRNA was not distinguishable from Let-7c. This was demonstrated by the similar cycle thresholds ($C_T$) observed for Let-7a and Let-7c, which were 23.43 and 23.73, respectively, at a concentration of 3.50E-05 ng/µl (Table 7).

However, using a Let-7a-specific MGB probe with one mismatch to the adaptor sequence (FIG. 4) enabled the distinction between Let-7a and Let-7c via real time PCR, as shown by the difference in their corresponding $C_T$ (Table 7). The $C_T$ for Let-7a and Let-7c as detected by the one mismatch Let-7a-specific probe were 28.3 and not detected (ND) after 40 cycles, respectively, at a concentration of 3.50E-05 ng/µl.

The high specificity remained even when very similar miRNAs were mixed (Let-7a, Let-7c and Let-7d). As shown in Table 8A, the detected $C_T$ in the mixture was almost identical to the one detected for each of the miRNAs separately.

The above-described method was also successfully tested using a Let-7a-specific MGB probe with two 5' mismatches to the adaptor sequence. As shown in Table 7, use of the two mismatch Let-7a-specific probe enabled differential detection of Let-7a and Let-7c at a concentration of 3.50E-04 ng/µl, but increased the $C_T$ compared to the one mismatch Let-7a-specific probe.

TABLE 5

Detection of the Let-7 family members by a Let-7a probe

| | | $C_T$ | | |
|---|---|---|---|---|
| RNA | Conc. (ng/µl) | 2 mismatch | 1 mismatch | 0 mismatch |
| Let-7a | 3.50E−04 | 25.15 | 23.87 | 19.58 |
| | 3.50E−05 | 29.35 | 28.27 | 23.43 |
| | 3.50E−06 | 32.65 | 31.60 | 26.77 |
| Let-7c | 3.50E−04 | 33.81 | 31.89 | 19.92 |
| | 3.50E−05 | ND | ND | 23.73 |
| | 3.50E−06 | ND | ND | 27.02 |
| Let-7d | 3.50E−04 | 30.50 | 29.63 | 27.03 |
| | 3.50E−05 | 35.02 | 34.16 | 30.08 |
| | 3.50E−06 | 37.91 | 37.17 | 33.22 |

Table 6A also shows that a Let-7c-specific probe be with one mismatch compared to the adaptor sequence, detects Let-7c with a $C_T$ lower than that for Let-7a or Let-7d, therefore demonstrating an ability to distinguish between Let-7c and its other family members. Likewise, a 1 mismatch Let-7d-specific probe detected Let-7d at a lower $C_T$ compared to Let-7a or Let-7c.

TABLE 6a

A Detection of the Let-7 family members by Let-7 family probes

| RNA | Fwd primer: Let-7a MGB probe: Let-7a | | Fwd primer: Let-7d MGB probe: Let-7d | | Fwd primer: Let-7c MGB probe: Let-7c | |
|---|---|---|---|---|---|---|
| | Conc. (ng/µl) | $C_T$ 1 mismatch | RNA Conc. (ng/µl) | $C_T$ 1 mismatch | RNA Conc. (ng/µl) | $C_T$ 1 mismatch |
| Let-7a | 3.5E−04 | 25.42 | Let-7a 3.5E−04 | 32.48 | Let-7a 3.5E−04 | 38.65 |
| | 3.5E−05 | 29 | 3.5E−05 | 35.9 | 3.5E−05 | ND |
| | 3.5E−06 | 32.57 | 3.5E−06 | 38.59 | 3.5E−06 | ND |
| Let-7c | 3.5E−04 | 36.08 | Let-7c 3.5E−04 | ND | Let-7c 3.5E−04 | 25.17 |
| | 3.5E−05 | ND | 3.5E−05 | ND | 3.5E−05 | 31.11 |
| | 3.5E−06 | ND | 3.5E−06 | ND | 3.5E−06 | 32.81 |
| Let-7d | 3.5E−04 | 31.99 | Let-7d 3.5E−04 | 20.76 | Let-7d 3.5E−04 | ND |
| | 3.5E−05 | 35.88 | 3.5E−05 | 24.54 | 3.5E−05 | ND |
| | 3.5E−06 | ND | 3.5E−06 | 27.83 | 3.5E−06 | ND |
| Mix: Let7 a + c + d | 3.5E−04 | 25.49 | Mix: 3.5E−04 | 20.72 | Mix: 3.5E−04 | 25.18 |
| | 3.5E−05 | 28.85 | Let7 3.5E−05 | 24.29 | Let7 3.5E−05 | 31.18 |
| | 3.5E−06 | 33.52 | a + c + d 3.5E−06 | 27.84 | a + c + d 3.5E−06 | 32.67 |

The above-described method was also successfully tested using oligodT primers comprising a mismatch to the cDNA adaptor sequence at different positions as indicated in Table 6B (SEQ ID NOS 20853-20856).

The results described in Table 5 and Table 6A-B demonstrate that real time PCR using a probe or oligodT primers as described herein is capable of differentially detecting target nucleic acids that differ in sequence by a few as one nucleotide.

EXAMPLE 20

Detecting a Single Nucleotide Difference: miR-99a Versus miR-100

The single nucieotide difference between the miRNAs miR-99a and miR-100 was also detected using real time PCR using a method similar to that described in Examples 1 and 2. The sequences of the miRNAs were as follows:

TABLE 6B

Detection of the Let-7 family members by using oligidT primers comprising a mismatch at different positions

| | synthetic miRNA target | | | | | | | | |
|---|---|---|---|---|---|---|---|---|---|
| | let-7a | | | let-7c | | | let-7d | | |
| | 3.5E-04 | 3.5E-05 | 3.5E-06 | 3.5E-04 | 3.5E-05 | 3.5E-06 | 3.5E-04 | 3.5E-05 | 3.5E-06 |
| Adaptor: GCGAGCACAGAATTAATACGACTCACTATCGGTTTTTTTTTTTVN SEQ ID NO. 20837 | | | | | | | | | |
| let-7a | 26.1 | 29.44 | 33.64 | ND | ND | ND | 30.42 | 34.27 | 38.4 |
| let-7c | 47.38 | ND | ND | 26.86 | 32.58 | 36.72 | ND | ND | ND |
| let-7d | 32.04 | 35.94 | 39.49 | ND | ND | ND | 20.72 | 24.5 | 28.06 |
| Adaptor: GCGAGCACAGAATTAATACGACTCACTATCGGTTTTTTTTTTTVN SEQ ID NO. 20837 | | | | | | | | | |
| let-7a | 25.42 | 29 | 32.57 | 36.08 | ND | ND | 31.99 | 35.88 | 41.13 |
| let-7c | 38.65 | ND | ND | 25.17 | 31.11 | 32.81 | 45.8 | ND | ND |
| let-7d | 32.48 | 35.9 | 38.59 | ND | ND | ND | 20.76 | 24.54 | 27.83 |
| Adaptor: GCGAGCACAGAATTAATACGACTCACTATCCCTTTTTTTTTTTVN SEQ ID NO. 20855 | | | | | | | | | |
| let-7a | 26.6 | 30.49 | 34.85 | ND | ND | 43.17 | 30.37 | 34.86 | 39.22 |
| let-7c | ND | ND | ND | 26.66 | 32.48 | 34.65 | ND | ND | ND |
| let-7d | 32.01 | 35.87 | 39.67 | ND | ND | ND | 21.01 | 24.84 | 27.77 |
| Adaptor: GCGAGCACAGAATTAATACGACTCACTATCCGTTTTTATTTTTTVN SEQ ID NO. 20856 | | | | | | | | | |
| let-7a | 29.72 | 36.16 | 38.86 | ND | ND | ND | ND | ND | ND |
| let-7c | ND | ND | ND | 32.01 | ND | ND | ND | ND | ND |
| let-7d | 33.08 | 39 | 41.68 | ND | ND | ND | 22.47 | 26.19 | 29.08 |
| Adaptor: GCGAGCACAGAATTAATACGACTCACTATCCGATTTTTTTTTTVN SEQ ID NO. 20858 | | | | | | | | | |
| let-7a | 24.54 | 29.43 | 33.08 | ND | ND | ND | 31.67 | 34.87 | 37.23 |
| let-7c | ND | ND | ND | 26.13 | 33.13 | 35.55 | ND | ND | ND |
| let-7d | 31.01 | 35.21 | 37.93 | ND | ND | ND | 21.34 | 24.3 | 27.53 | miR-99a:  5'-AACCCGUAGAUCCGAUCUUGUG-3'  (SEQ ID NO: 20843)

miR-100:  5'-AACCCGUAGAUCCGAACUUGUG-3'  (SEQ ID NO: 20844)

As shown in Table 9, a probe with 1 mismatch to the cDNA adaptor sequence, but no mismatch compared to miR-99a recognized miR-99 at a $C_T$~9 cycles lower compared to miR-100, at the same RNA concentration.

Conversely, a probe with 1 mismatch to the cDNA adaptor sequence, but no mismatch to miR-100 recognized miR-100 at a $C_T$ which was about 5 cycles lower than the $C_T$ detected for miR-99. The high specificity of the method of the present invention remains even when these very similar miRNAs were mixed together (Table 7).

TABLE 7

Detection of hsa-miR-99a and hsa-miR-100

| RNA | Fwd primer: hsa-miR-99 MGB probe: miR-99 | | RNA | Fwd primer: hsa-miR-100 MGB probe: miR-100 | |
|---|---|---|---|---|---|
| | Amount (fmole) | $C_T$ | | Amount (fmole) | $C_T$ |
| miR-99a | 1.00E−02 | 26.42 | miR-99a | 1.00E−02 | 30.85 |
| | 2.50E−04 | 28.05 | | 2.50E−04 | 32.03 |
| | 6.25E−05 | 30.27 | | 6.25E−05 | 34.05 |
| | 1.56E−05 | 32.26 | | 1.56E−05 | 35.99 |
| miR-100 | 1.00E−02 | 35.49 | miR-100 | 1.00E−02 | 24.78 |
| | 2.50E−04 | 37.46 | | 2.50E−04 | 26.99 |
| | 6.25E−05 | 39.33 | | 6.25E−05 | 29.27 |
| | 1.56E−05 | 40.97 | | 1.56E−05 | 31.89 |
| Mix: | 1.00E−02 | 27.13 | Mix: | 1.00E−02 | 27.82 |
| miR-99 + | 2.50E−04 | 29.2 | miR-99 + | 2.50E−04 | 29.78 |
| miR-100 | 6.25E−05 | 31.57 | miR-100 | 6.25E−05 | 31.88 |
| | 1.56E−05 | 34.09 | | 1.56E−05 | 34.26 |

Example 5

Sensitivity for Detecting a Target Nucleic Acid

The sensitivity of real time PCR was also tested. hsa-miR-122a, which is a liver specific miRNA, was amplified from different RNA sources (brain, liver and Hela cells, or mixtures thereof) by real time reverse transcription-PCR, according to the method described in Examples 1 and 2 using a miR-122a-specific probe. The initial RNA amount per reverse transcription reaction was 0.5 ng of total RNA. The amount of the brain total RNA was increased, while the amount of liver total RNA was decreased (according to the ratios listed in Table 8).

As shown in Table 8, liver-specific miRNA expression was detected. No signal was detected from a RNA source other than liver (Brain, HeLa), but was detected from liver RNA. Additionally, when the amount of liver RNA was decreased by half, the $C_T$ increased by 1, until the number of relevant molecules was low (less than ~20 molecules). Furthermore, even when as little as 0.03125% of an RNA pool was from liver, miR-122a was detected in a background of 99.96875% irrelevant RNA. Such sensitivity has not been achieved by other known methods.

TABLE 8

Detection of miR-122a in RNA from different sources

| RNA source | Average $C_T$ | STDEV | $\Delta C_T$ |
|---|---|---|---|
| Brain | | | |
| HeLa | | | |
| Liver | | | |
| HeLa 96%, Liver 4% | 32.63 | 0.22 | 0.78 |
| HeLa 98%, Liver 2% | 33.41 | 0.14 | 1.00 |
| HeLa 99%, Liver 1% | 34.41 | 0.35 | 1.38 |
| HeLa 99.5%, Liver 0.5% | 35.79 | 0.60 | 0.83 |
| HeLa 99.75%, Liver 0.25% | 36.62 | 0.82 | 0.98 |
| HeLa 99.875%, Liver 0.125% | 37.60 | 0.72 | 0.87 |
| HeLa 99.9375%, Liver 0.0625% | 38.47 | 0.96 | 1.48 |
| HeLa 99.96875%, Liver 0.03125% | 39.95 | | |
| Brain | ND | ND | |
| Liver | 27.38 | 0.17 | |
| HeLa | ND | ND | |

Example 6

Detection of Synthetic miR 124a in a Diverse RNA Background

The sensitivity of the method described in Examples 1 and 2 was tested by detecting a particular target nucleotide sequence when low concentrations of the target are present within a high background concentration of nucleic acids. Reduced amounts of synthetic miR-124a were added to 0.05 ng of total background RNA from HeLa cells for a final concentration ranging from $2.35 \times 10^{-6}$ fmol to $1.16 \times 10^{-9}$ fmol of miR-124a target nucleotide sequences. Each concentration was performed in 5 replicates. The average $C_T$ and standard deviation were calculated. Table 9 demonstrates that the background RNA from the HeLa cells provided a signal of 47.61 $C_T$. The $C_T$ was increased by ~1 when the amount of synthetic 124a-RNA was decreased by half in the higher concentrations. The minimal amount of synthetic 124a-RNA that gave a signal above the background signal is $1.86 \times 10^{-8}$ fmol.

TABLE 9

Detection of synthetic miR-124a in a diverse RNA background

| RNA: miR-124a | Average | STDEV | $\Delta Ct$ |
|---|---|---|---|
| 2.38E−06 fmol | 35.18 | 0.43 | 1.06 |
| 1.19E−06 fmol | 36.24 | 0.36 | 1.00 |
| 5.95E−07 fmol | 37.24 | 0.75 | 1.59 |
| 2.98E−07 fmol | 38.83 | 1.03 | 3.58 |
| 1.49E−07 fmol | 42.42 | 3.35 | 1.41 |
| 7.44E−08 fmol | 43.82 | 5.04 | −0.11 |
| 3.72E−08 fmol | 43.72 | 4.57 | 2.78 |
| 1.86E−08 fmol | 46.50 | 3.38 | 1.76 |
| 9.30E−09 fmol | 48.26 | 1.41 | 0.07 |
| 4.65E−09 fmol | 48.33 | 2.35 | 1.27 |
| 2.32E−09 fmol | 49.60 | 0.55 | −1.55 |
| 1.16E−09 fmol | 48.05 | 2.69 | |
| HeLa 0.05 ng | 47.61 | 2.93 | |
| Brain 0.05 ng | 25.34 | 0.12 | |
| No cDNA | ND | | |

Example 7

Detection of Different miRNA Target Sequences in Human Serum

The method described in Examples 1 and 2 was then applied to detecting many miRNA target sequences in the human serum. Total RNA was extracted from serum samples of three individuals by using LS buffer (Promega) in combination with the Mirvana kit (Ambion). Volumes of 300 µl of serum were obtained from subject number 5 and 7, and 150 µl of serum was obtained from subject number 6 for RNA purification. A total of 10% of the purified RNA was used for each PCR and hybridization reaction according to the methods described above. Probes specific for the miR target sequences are shown in Table 12 below. Table 10 demonstrates that different microRNAs such as miR-21, hsa-miR-142-3p and Let-7d could specifically be detected in a serum sample. Table 10 indicates that various miRNA target sequences can be extracted, isolated and detected from biological fluids such as human serum.

TABLE 10

Detection of different microRNA target sequences in human serum

| Fwd primer and MGB probe | Sample no. 5 $C_T$ | Sample no. 6 $C_T$ | Sample no. 7 $C_T$ |
|---|---|---|---|
| hsa-miR-21 | 33.03 | 31.28 | 29.55 |
| hsa-miR-142-3p | 35.3 | 39.27 | 37.16 |
| Let-7a | ND | 39.22 | 36.63 |
| Let-7c | ND | ND | ND |
| Let7-d | 33.89 | 34.71 | 34.01 |
| hsa-miR-99a | ND | ND | ND |
| hsa-miR-100 | ND | ND | ND |
| hsa-miR-125a | ND | ND | ND |
| hsa-miR-125b | 36.72 | 36.3 | 39.37 |
| hsa-miR-122a | 38.6 | 35.8 | 35.99 |
| hsa-miR-124a | ND | ND | ND |

Example 8

Detection of Different miRNA Target Sequences in Formalin Fixed, Paraffin-Embedded (FFPE) Tissues RNA was isolated from formalin fixed, paraffin-embedded (FFPE) tissues originated from bladder, prostate and liver with colon metastasis.

1 ml Xylene (Biolab) was added to 1-2 mg tissue, incubated at 57° C. for 5 min and centrifuged for 2 min at 10,000 g. The supernatant was removed, and 1 ml Ethanol (100%) (Biolab) was added. Following centrifugation for 10 min at 10,000 g, the supernatant was discarded and the washing procedure was repeated. Following air drying for 10-15 min, 500 µl Buffer B (NaCl 10 mM, Tris pH 7.6, 500 mM, EDTA 20 mM, SDS 1%) and 5 ul proteinase K (50 mg/ml) (Sigma) were added. Following incubation at 45° C. for 16 h, inactivation of the proteinase K at 100° C. for 7 min was preformed. Following extraction with acid phenol chloroform (1:1) (Sigma) and centrifugation for 10 min at maximum speed at 4° C., the upper phase was transferred to a new tube with the addition of 3 volumes of 100% Ethanol, 0.1 volume of NaOAc (BioLab) and 8 µl glycogen (Ambion) and left over night at −20° C.

Following centrifugation at maximum speed for 40 min at 4° C., washing with 1 ml Ethanol (85%), and drying, the RNA was re-suspended in 45 µl DDW.

The RNA concentration was tested and DNase Turbo (Ambion) was added accordingly (1 µl DNase/10 µg RNA). Following Incubation for 30 min at room temperature and extraction with acid phenol chloroform and precipitation, the RNA was re-suspended in 45 µl DDW. The RNA concentration was tested again and DNase Turbo (Ambion) was added accordingly (1 µl DNase/10 µg RNA). Following incubation for 30 min at room temperature and extraction with acid phenol chloroform and precipitation, the RNA was re-suspended in 20 µl DDW.

A total of 10% of the purified RNA was used for each PCR and hybridization reaction according to the methods described above. Probes specific for the miR target sequences are shown in Table 11 below. Table 13 demonstrates that different microRNAs could specifically be detected in FFPE sample. Table 11 indicates that various microRNA target sequences can be extracted, isolated and detected from FFPE tissues.

TABLE 11

Detection of different microRNA target sequences in (FFPE) tissues

| Fwd primer and MGB probe | $C_T$ Bladder | $C_T$ Bladder | $C_T$ Liver-Colon | $C_T$ Liver-Colon | $C_T$ Bladder | $C_T$ Prostate |
|---|---|---|---|---|---|---|
| Let7d | 35.27 | 35.37 | 38.28 | 38.6 | 37.27 | 35.9 |
| miR-126 | 34.33 | 34.2 | 34.75 | 33.54 | 35.48 | 34.72 |
| miR-24 | 31.22 | 31.12 | 34.35 | 33.24 | 34.34 | 33.03 |
| miR-21 | 33.07 | 31.88 | 31.56 | 30.68 | 29.85 | 31.41 |
| miR-122a | ND | ND | 31.58 | 33.02 | ND | ND |
| miR-494 | ND | ND | ND | ND | ND | ND |
| miR-125a | 36.87 | 37.08 | 37.54 | 36.11 | 38.17 | 37.59 |
| miR-125b | 34.45 | 34.64 | 30.31 | 30.97 | 32.79 | 29.89 |
| miR-145 | 35.03 | 36.19 | 34.13 | 33.2 | 32.68 | 29.81 |
| miR-194 | 39.01 | 40.69 | 33.75 | 33.5 | 42.9 | 44.2 |
| miR-205 | 29.22 | 29.13 | ND | ND | 33.38 | 32.05 |
| miR-124a | ND | ND | ND | ND | | ND |

Example 9

Detection of Different miRNA Target Sequences in Amniotic Fluids 20 ml of Amniotic fluid (non miconial) was collected during caesarean surgery, into 2×15 ml tubes. Cells were recovered by centrifugation at 1000 g for 10 minutes at 4° C. Supernatant was collected and aliquoted to eppendorf tubes at volumes of 400 µl and frozen at −80° C. Cell pellet was re-suspended with PBS and re-centrifuged at the same conditions. Then pellet was re-suspended in 0.5 ml buffer A (taken from EZ-RNA II kit by Biological Industries), transferred to an eppendorf tube and stored at −80° C.

RNA from Amniotic cell fraction was extracted using EZ-RNA II kit (Biological Industries, Israel) according to the manufacturer's protocol.

RNA in the amniotic fluid supernatant is extracted as described below:

100 µl of sample was incubated at 56° C. for 1 h in 0.8 ml of pre-heated extraction solution (NaCl, 0.1M; Tris Hcl pH8, 10 mM; DTT, 40 mM; EDTA pH8, 10 mM; SDS 70 mM; Proteinase K, 0.65 mg/ml). Spikes were added as control.

90 µl of 3M NaOAc and 1 ml of acid phenol:chloroform were added. Incubation at 4° C. until two phases were separated (at least 20 min). Centrifugation was preformed at 16,000 g for 20 min at RT. The aqueous phase (~1 ml) was transferred to a new tube. 8 µl glycogen and 3 vol. ETOH were added and precipitated ON at −20° C. Centrifugation was preformed for 40 min at max speed at 4° C.

The pellet was washed with 85% ETOH, dried at 65° C. and re-suspended in 43 µl DDW. 2 µl Turbo DNase (Ambion) and 5 µl Buffer were added, and incubation was preformed for 1 h at 37° C.

Following extraction with acid phenol:chloroform, the pellet was re-suspend in 20 µl DDW.

RNA isolated from 100 μl of amniotic fluid was used for each PCR and hybridization reaction according to the methods described in Examples 1 and 2.

Table 12 demonstrates that different microRNAs could specifically be detected in amniotic fluid samples obtained from 6 individuals. Table 12 indicates for the first time that various microRNA target sequences can be extracted, isolated and detected from amniotic fluid samples.

TABLE 12

Detection of different microRNA target sequences in amniotic fluids

| $C_T$ 1 | 2 | 3 | 4 | 5 | 6 | miR name |
|---|---|---|---|---|---|---|
| 35.16 | 37.78 | 34.01 | 35.67 | 33.79 | 33.71 | Let7d |
| 34.8 | 44.23 | 35.78 | 38.97 | 38.05 | 36.42 | miR-126 |
| 32.63 | 33.99 | 30.28 | 31.89 | 31.52 | 30.62 | miR-24 |
| 30.52 | 33.01 | 29.64 | 30.15 | 30.2 | 28.97 | miR-21 |
| 31.73 | 34.56 | 32.41 | 32.64 | 31.92 | 31.91 | miR-16 |
| 35.47 | 40.9 | 36.79 | 42.42 | 38.92 | 38.6 | miR-451 |

Example 10

Detection of Different miRNA Target Sequences in Human Urine

The protocol used for miRNA extraction from urine (500 μl) is the same as described in Example 9. Table 13 demonstrates that different microRNAs could specifically be detected in human urine sample. Table 13 indicates for the first time that various microRNA target sequences can be extracted, isolated and detected from human urine.

TABLE 13

Detection of different microRNA target sequences in human urine

| miR name | $C_T$ |
|---|---|
| miR-103 | 39.2798 |
| miR-22 | 37.341 |
| miR-320 | 38.038 |
| miR-192 | 39.793 |
| miR-200c | 39.0157 |
| miR-92 | 36.7871 |
| miR-21 | 34.3883 |
| miR-375 | 38.0334 |
| miR-93 | 39.6563 |
| U6 snRNA | 36.9035 |

Example 11

Detection of Different miRNA Target Sequences in Saliva, Pleural and Breast Secretions The protocol used for miRNA extraction from saliva, pleural and breast secretions is the same as described in Example 9 with minor modifications. To improve the purity of saliva RNA extracted the incubation with proteinase K was extended for 3 h and RNA was precipitated at −80° C. overnight.

Tables 14A-B demonstrate that different microRNAs could specifically be detected in human saliva, pleural and breast secretions. Tables 14A-B indicate for the first time that various microRNA target sequences can be extracted, isolated and detected from human saliva pleural and breast secretions.

TABLE 14a

Detection of different microRNA target sequences in human saliva

| target | cDNA, 5 ng/ul | cDNA 1 ng/ul |
|---|---|---|
| miR-205 | undetected | undetected |
| miR-21 | 31.64 | 33.86 |
| miR-223 | 27.29 | 29.10 |
| miR-491 | 35.16 | 37.22 |
| miR-494 | undetected | undetected |
| U6 | 24.89 | 27.10 |

TABLE 14B

Detection of different microRNA target sequences in human pleural and breast secretions

| | Breast | | | Pleural | | |
|---|---|---|---|---|---|---|
| target | 2.5 | 0.25 | Δ 0.25 – 2.5 | 2.5 | 0.25 | Δ 0.25 – 2.5 |
| let7d | 37.6 | 40.05 | 2.45 | 33 | 36.88 | 3.88 |
| mir-126 | ND | ND | ### | 34.26 | 37.4 | 3.14 |
| hsa-miR-24 | ND | ND | ### | 30.74 | 34.49 | 3.75 |
| mir-21 | 34.22 | 37.47 | 3.25 | 27.18 | 30.82 | 3.64 |
| hsa-miR-16 | 41 | ND | ### | 30.8 | 34.41 | 3.61 |
| hsa-miR-451 | ND | ND | ### | 33 | 37.53 | 4.53 |

Example 12

Using ECLIPSE® Probes for Detecting a Target Nucleic Acid

MGB ECLIPSE® probes carry a minor binder moiety that allows the use of short probes for very high specificity. These are short linear probes that have a minor groove binder and a fluorophore (or quencher) on the 5' end and a quencher (or fluorophore) on the 3' end, which is the opposite orientation of the MGB molecule used in Example 3 (TaqMan MGB probes). The minor groove binder may prevent the exonuclease activity of the Taq polymerase from cleaving the probe.

The ECLIPSE® MGB molecule was used in a quantitative real time PCR reaction according to the same conditions which were used with the previous MGB probes. The sequences of the Oligo dT PCR primers and probes are presented below.

```
                              (SEQ ID NO. 20860)
Probe Let7A21:     CCGTTTTTTTTTTAACTATAC
```

```
                              (SEQ ID NO. 20861)
Probe Let7C21:     CCGTTTTTTTTTTAACCATAC
```

The RT-primer sequence that was used for the ECLIPSE® reaction:

```
                                        (SEQ ID NO. 20862)
RT10:  GCGAGCACAGAATTAATACGACTCACTATCGGTTTTTTTTTTVN
```

Using a Let-7a or Let-7c-specific ECLIPSE® MGB probes with one mismatch to the adaptor sequence enabled the distinction between Let-7a and Let-7c via real time PCR, as shown by the difference in their corresponding $C_T$ (Table 17).

TABLE 15

Detection of the Let-7 family members by ECLIPSE +200 MGB probe

| RNA sample name | Probe &primer Let7A | Probe &primer Let7C |
|---|---|---|
| Let7A RNA | 27.38 | 35.49 |
| Let7C RNA | 31.27 | 30.63 |
| Let7A + C RNA | 26.88 | 31.99 |
| Let7A RNA | 31.4 | 40.04 |
| Let7C RNA | 33.43 | 34.89 |
| Let7A + C RNA | 31.25 | 37.1 |
| Let7A RNA | 35.97 | 43.46 |
| Let7C RNA | 40.15 | 41.41 |
| Let7A + C RNA | 34.09 | 39.8 |

Example 13

Prediction of mRNAs

We surveyed the entire human genome for potential miRNA coding genes using computational approaches similar to those described in U.S. Patent Application Nos. 60/522,459, 10/709,577 and 10/709,572, the contents of which are incorporated herein by reference, for predicting miRNAs. Briefly, non-protein coding regions of the entire human genome were scanned for hairpin structures. The predicted hairpins and potential miRNAs were scored by thermodynamic stability, as well as structural and contextual features. The algorithm was calibrated by using miRNAs in the Sanger Database which had been validated. Table 1 of U.S. patent application Ser. No. 11/429,720, the contents of which are incorporated herein, lists the SEQ ID NO for each predicted hairpin ("HID") from the computational screen. Table 1 of U.S. patent application Ser. No. 11/429,720 also lists the genomic location for each hairpin ("Hairpin Location"). The format for the genomic location is a concatenation of <chr_id><strand><start position>. For example, 19+135460000 refers chromosome 19, +strand, start position 135460000. Chromosomes 23-25 refer to chromosome X, chromosome Y and mitochondrial DNA, respectively. The chromosomal location is based on the hg17 assembly of the human genome by UCSC (genome.ucsc.edu), which is based on NCBI Build 35 version 1 (35.1) and was produced by the International Human Genome, Sequencing Consortium.

Table 1 of U.S. patent application Ser. No. 11/429,720 also lists whether the hairpin is conserved in evolution ("C"). The hairpins were identified as conserved ("Y") or nonconserved ("N") by using phastCons data. The phastCons data is a measure of evolutionary conservation for each nucleotide in the human genome against the genomes of chimp, mouse, rat, dog, chicken, frog, and zebrafish, based on a phylo-HMM using best-in-genome pair wise alignment for each species based on BlastZ, followed by multiZ alignment of the 8 genomes (Siepel et al, J. Comput. Biol 11, 413-428, 2004 and Schwartz et al., Genome Res. 13, 103-107, 2003). A hairpin is listed as conserved if the average phastCons conservation score over the 7 species in any 15 nucleotide sequence within the hairpin stem is at least 0.9 (Berezikov, E. et al. Phylogenetic Shadowing and Computational Identification of Human microRNA Genes. Cell 120, 21-24, 2005). Table 1 of U.S. patent application Ser. No. 11/429,720 also lists the genomic type for each hairpin ("T") as either intergenic ("G"), intron ("I") or exon ("E"). Table 1 of U.S. patent application Ser. No. 11/429,720 also lists the SEQ ID NO ("MID") for each predicted miRNA and miRNA*. Table 1 of U.S. patent application Ser. No. 11/429,720 also lists the prediction score grade for each hairpin ("P") on a scale of 0-1 (1 the hairpin is the most reliable), as described in Hofacker et al., Monatshefte f. Chemie 125: 167-188, 1994. If the grade is zero or null, they are transformed to the lower value of PalGrade that its p-value is <0.05. Table 1 of U.S. patent application Ser. No. 11/429,720 also lists the p-value ("Pval") calculated out of background hairpins for the values of each P scores. As shown in Table 1 of U.S. patent application Ser. No. 11/429,720, there are few instances where the Pval is >0.05. In each of these cases, the hairpins are highly conserved or they have been validated (F=Y). Table 1 of U.S. patent application Ser. No. 11/429,720 also lists whether the miRNAs were validated by expression analysis ("E"); this column was intentionally left blank. Table 1 of U.S. patent application Ser. No. 11/429,720 also lists whether the miRNAs were validated by sequencing ("S") (Y=Yes, N=No). If there was a difference in sequences between the predicted and sequenced miRNAs, the sequenced sequence is predicted. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different condition than those of the experimental cells. Table 1 of U.S. patent application Ser. No. 11/429,720 also lists whether the miRNAs were shown to be differentially expressed ("D") (Y=Yes, N=No) in at least one disease, as detailed in Table 2 of U.S. patent application Ser. No. 11/429,720, the contents of which are incorporated herein. Table 1 of U.S. patent application Ser. No. 11/429,720 also lists whether the miRNAs were present ("F") (Y=Yes, N=No) in Sanger DB Release 8 (February 2005) (nar.oupjournals.org/) as being detected in humans or mice or predicted in humans. As discussed above, the miRNAs listed in the Sanger database are a component of the prediction algorithm and a control for the output. Table 1 of U.S. patent application Ser. No. 11/429,720 also lists a genetic location cluster ("LC") for those hairpins that are within 5,000 nucleotides of each other. Each miRNA that has the same LC share the same genetic cluster. Table 1 of U.S. patent application Ser. No. 11/429,720 also lists a seed cluster ("SC") to group miRNAs by their seed of 2-7 by an exact match. Each miRNA that has the same SC have the same seed. For a discussion of seed lengths of 5-6 nucleotides being sufficient for miRNA activity, see Lewis et al., Cell, 120; 15-20 (2005).

Example 14

Prediction of Target Genes

The predicted miRNAs from the computational screening of Example 13 were then used to predict target genes and their binding sites using two computational approaches similar to those described in U.S. Patent Application Nos. 60/522,459, 10/709,577 and 10/709,572, the contents of which are incorporated herein by reference, for predicting miRNAs.

Table 4 of U.S. patent application Ser. No. 11/429,720, the contents of which are incorporated herein by reference, lists the predicted target gene for each miRNA (MID) and its hairpin (HID) from the computational screen. The names of the target genes were taken from NCBI Reference Sequence release 16 (http://www.ncbi.nlm.nih.gov; Pruitt et al., Nucleic Acids Res, 33(1):D501-D504, 2005; Pruitt et al., Trends Genet., 16(1):44-47, 2000; and Tatusova et al., Bioinformatics, 15(7-8):536-43, 1999). Target genes were identified by having a perfect complementary match of a 7 nucleotide miRNA seed (positions 2-8) that have an "A" after the seed on the UTR and/or an exact match in the nucleotide before the seed (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLOS Biol 2005). Binding sites were then predicted using a filtered target genes dataset by including only those target genes that contained a UTR of a least 30 nucleotides. The binding site screen only considered the longest transcript when there were several transcripts per gene. A total of 16,656 transcripts were included in the dataset. Table 4 of U.S. patent application Ser. No. 11/429,720 lists the SEQ ID NO for the predicted binding sites for each target gene as predicted from each miRNA ("MID"). The sequence of the binding site includes the 20 nucleotides 5' and 3' of the binding site. If the binding site encompasses 2 exons, the sequence includes 20 nucleotides 5' and 3' of the binding site, as the ends are situated on the spliced mRNA. Table 5 of U.S. patent application Ser. No. 11/429,720, the contents of which are incorporated herein, shows the relationship between the miRNAs ("MID")/hairpins ("HID") and diseases by their target genes. The names of diseases are taken from OMIM. For a discussion of the rational for connecting the host gene the hairpin is located upon to disease, see Baskerville and Bartel, RNA, 11: 241-247 (2005) and Rodriguez et al., Genome Res., 14: 1902-1910 (2004). Table 5 of U.S. patent application Ser. No. 11/429,720 shows the number of miRNA target genes ("N") that are related to the disease. Table 5 of U.S. patent application Ser. No. 11/429,720 also shows the total number of genes that are related to the disease ("T"), which is taken from the genes that were predicted to have binding sites for miRNAs. Table 5 of U.S. patent application Ser. No. 11/429, 720 also shows the percentage of N out of T ("P") and the p-value of hypergeometric analysis ("Pval"). Table 8 of U.S. patent application Ser. No. 11/429,720, the contents of which are incorporated herein, shows the disease codes for the diseases described in Table 5 of U.S. patent application Ser. No. 11/429,720 and Tables 9-11 of U.S. patent application Ser. No. 11/429,720, the contents of which are incorporated herein. For a reference of hypergeometric analysis, see Schaum's Outline of Elements of Statistics II: Inferential Statistics. Table 9 of U.S. patent application Ser. No. 11/429, 720 shows the relationship between the target sequences ("Gene Name") and disease ("Disease Code"). Table 10 of U.S. patent application Ser. No. 11/429,720 shows the relationship between the miRNAs ("MID")/hairpins ("HID"), known SNPs and diseases. SNP were identified in the sequence of hairpins. For the miRNAs of these hairpins, all their target genes listed in Table 4 of U.S. patent application Ser. No. 11/429,720 were collected. For these genes, we checked whether they are associates to disease(s) according to OMIM. The numeric code of the relevant diseases for each miRNA according to Table 9 of U.S. patent application Ser. No. 11/429,720 are presented in Table 10 of U.S. patent application Ser. No. 11/429,720. The disease codes are taken from Table 8 of U.S. patent application Ser. No. 11/429,720. If a target gene was not related to a disease in Table 9 of U.S. patent application Ser. No. 11/429,720, SNP data is not presented. Each SNP ("SNP_Id") is identified based on NCBI database dbSNP BUILD 124 based on NCBI Human Genome Build 35.1. The genomic location for each SNP ("SNP_location") is also provided in a formation concatenating "<chr_id>:<start position>". For example, "19:135460569" means chr19+strand, start position 135460569. Although the mutations are referred to as SNPs, a number of the mutations cover a few nucleotides (e.g., small insertions, deletions, micro-satellites, etc.) For a discussion on the connection between a SNP and disease, see Swibertus (Blood 1996) and Frittitta (Diabetes 2001). Table 11 of U.S. patent application Ser. No. 11/429,720 shows the relationship between miRNAs ("MID"), hairpins ("HID"), SNP identification number ("SNP_Id"), SNP location ("SNP_location"), genes and diseases. SNP identification and location are defined as described for Table 10 of U.S. patent application Ser. No. 11/429,720. The SNPs listed are only those that are located in a miRNA target gene known to be associated with a disease in the OMIM database. "Gene" indicates the name of the gene in which the SNP is located.

Example 15

Differential Expression of miRNAs

1. Sequencing

To validate the hairpins ("HID"), a number of miRNAs were evaluated by sequencing methods similar to those described in. U.S. Patent Application Nos. 60/522,459, 10/709,577 and 10/709,572, the contents of which are incorporated herein by reference. Table 3 of U.S. patent application Ser. No. 11/429,720, the contents of which are incorporated herein, shows the hairpins ("HID") that were validated by sequencing a miRNA ("MID") in the indicated tissue ("Tissue"). Numeric codes for the tissues are shown in Table 6 of U.S. patent application Ser. No. 11/429,720, the contents of which are incorporated herein.

2. Differential Expression

To confirm the hairpins and miRNAs predicted in Example 13, we detected expression in various tissues (versus controls) using the high-throughput microarrays similar to those described in U.S. Patent Application Nos. 60/522,459, 10/709,577 and 10/709,572, the contents of which are incorporated herein by reference. Microarray images were analyzed using Feature Extraction Software (Version 7.1.1, Agilent). Differential expression of the miRNAs was then analyzed in various disease tissues using similar methods described above. Table 2 of U.S. patent application Ser. No. 11/429,720 shows the ratio of disease related expression ("R") compared to normal tissues for the indicated diseases. Disease codes for the disease are shown in Table 7 of U.S. patent application Ser. No. 11/429,720. Table 2 of U.S. patent application Ser. No. 11/429,720 also shows the statistical analysis of the normalized signal ("RPval"). The signal of each probe was set as its median intensity. Signal intensities range from background level of 400 to saturating level of 66,000. 2 channels hybridization was performed and Cy3 signals were compared to Cy5 signals, where fluor reversed chip was preformed (normal vs. disease), probe signal was set to be its average signal. Signals were normalized by first performing a logarithmic transformation (log 2), followed by adapting a polynomic graph of the second degree. Following normalization, a t-test for each miRNA and disease was performed. P values were estimated based on the occurrences of such or greater signal ratios over duplicated experiments. miRNAs with a p value <0.05 are shown in Table 2 of U.S. patent application Ser. No. 11/429,720. The total number of samples ("N") used for each analysis is also shown in Table 2 of U.S. patent application Ser. No. 11/429,720. The differential expression analysis in Table 2 of U.S. patent application Ser. No. 11/429,720 indicates that the expression of a number of the miRNAs is significantly altered in disease tissue.

Example 16

Biochip

1. Probe Printing

Dried microRNA nucleic acid probes with the sequences listed in Table 7 (SEQ ID NOs 1-4167), were dissolved in 3× sodium chloride-sodium citrate buffer (SSC)+0.001% sodium dodecyl sulfate (SDS) or 2×SSC+0.0035% SDS to a final nucleic acid concentration of 20 µM or 10 µM. The probes were then spotted (i.e., printed) on Schott Nexterion® Slide E coated microarray slides using a Genomic Solutions® BioRobotics MicroGrid II according the MicroGrid manufacturer's directions. After spotting the probes, the biochips were processed according to the microarray slide manufacturer's directions. Briefly, the biochips were rehydrated in a humidity chamber with 0.5×SSC at 42° C., immediately dried for 3 sec on a 130° C. heating block, submerged in blocking buffer (1M Tris pH9, 50 mM ethanolamine, 0.1% SDS), and incubated for 20 min at 50° C. with frequent mixing. The biochips were then rinsed twice for 1 min in nuclease-free water. Finally the biochips were dried via centrifugation.

2. Preparing the Biological Sample

Total RNA from fresh tissues, cell lines, formalin-fixed paraffin-embedded RNA, and fractionated RNA enriched for small RNA molecules (after using a column/gel that separates the RNA according to size) was labeled with a fluorescent dye that enabled detection of RNAs hybridized to the biochip. RNA was labeled with a single fluorophore per molecule, and labeling was uniform across different small RNA molecules. The fluorophore was enzymatically attached by RNA ligase to the 3' end of the microRNAs in the sample. The following reagents were then mixed: RNA up to 3.5 µL, Spikes 1 µL, 10× ligation buffer (NEB) 1 µL, or RNA ligase buffer (Amersham) p-CU-Cy3/Cy5* 1 µL, DMSO 1.5 µL, RNAsine 1 µL, T4 RNA ligase (NEB) 1 µL, or RNA ligase (Amersham), DDW up to the final total volume (10 µL). *5'phosphate-rCrU-3-Cy3; 5'phosphate-rCr-U-3-Cy5 (r=ribonucleic acid nucleotide) The above mixture was incubated on a heating block for 1 hr at 4° C. followed by 1 hr at 37° C., or at 0° C. for 2-16 hr, or at 16° C. for 2-16 hr (for low RNA amount).

3. Hybridizing the Biochip

Briefly, labeled RNA was hybridized to the biochip as follows. 3×miRNA Hybridization Buffer from Ambion® was preheated to 70° C. for at least 5 min. A clean coverslip was placed over a printed biochip. The hybridization buffer was mixed with labeled RNAs (RNA-Cy3 labeled and RNA-Cy5 labeled) to achieve a final concentration of 1× buffer and this mixture (30 ul) was then placed on the biochip to cover the probes. Alternatively, a final concentration of 1× buffer and this mixture (110 ul) was placed on Agilent gasket slide with Agilent chamber base. The biochip was heated to 95° C. for 3 min, and then cooled to room temperature by centrifugation for 1 min at room temperature at maximum speed. Finally, the biochip was allowed to hybridize to the labeled RNA mixture for 12-16 hr at 42° C. or 48 hr (for low RNA amount) on water bath or Agilent oven. After hybridization, the biochip was washed for approximately 30 sec at room temperature, with Buffer A (1×SSC, 0.2% SDS), washed twice for 30 sec at room temperature with Buffer B (0.1×SSC), and then dried by centrifugation.

4. Scanning and Analyzing the Biochip

The biochip was scanned using an Agilent Microarray Scanner Bundle G2565BA, which enabled resolution of 10 µm or 5 µm at 100% power or 100% followed by 10%. The data were analyzed using SpotReader or Feature extraction software.

Example 17

High-Throughput Coupling of DNA Probes to LUMINEX® Microspheres

5. Preparing the Coupled LUMINEX® Beads

Carboxylated LUMINEX® microspheres (LUMINEX® xMap technology; Cat# L100-C (101-200)-01), or beads, are coupled to DNA probes that are amino-modified using EDC (1-ethyl-3-(3-dimethylaminopropyl) carbodiimide-HCl; Pierce. Product#77149). DNA probes, which are reverse complements of the target miRNAs, from the mirVana miRNA probe set (Ambion; Cat#1564) are used. The probes are 42-46 nucleotides (nt) long, of which 18-24 nt target a specific miRNA.

Coupling reactions are performed in 1.5 ml tubes and washed using a 96-well filter plate that is resistant to detergents (Multiscreen Solvinert; Millipore; Cat# MSRLN0410). A "coupling table," which specifies how each DNA probe should be coupled to one type of bead that has a unique spectral signature, is prepared. Each probe in a coupled bead mixture can thus be uniquely identified by its signature. Probes are resuspended in DDW to a final concentration of 0.1 mM.

Beads are resuspended by vortexing and sonicating for 20 seconds. 200 µl ($2.5 \times 10^6$ beads) is taken for each reaction. The beads are centrifuged for 2 minutes at maximum speed. The supernatant is removed and the beads are resuspended in 25 µl MES buffer (0.1M, pH 4.5), and vortexed and sonicated again.

1 µl of probe solution is added to the beads and the suspension is mixed by vortexing. 1.5 µl of freshly suspended EDC (10 mg/ml in DDW, pre-warmed to room temperature) is added to each reaction mix and the mixture is vortexed. The reaction is then incubated at room temperature in the dark for 30 minutes. 1.5 µl of fresh EDC is added again and vortexed, followed by another 30 minute incubation. Solvinert filter plates are pre-wetted with 100 µl water. The coupled reaction is then transferred from the tubes to the filter plate and a vacuum applied. 150 µl of 0.02% Tween-20 is added to coupling reaction and vacuumed twice. Two subsequent washes with 150 µl of 0.1% SDS are then performed. The coupled beads are resuspended in 50 µl of TE and thoroughly mixed. Finally, the coupled bead mixtures are transferred to 1.5 ml tubes and kept at 4° C.

Coupled bead mixtures are mixed in equal volumes into sets of 100 in which each of 100 probes is coupled with a different bead type with a unique spectral signature (i.e., 100 different types of beads). Coupled bead mixture sets are checked for the proportion of each couple via LUMINEX®. The mix is diluted in 1.5×TMAC hybridization buffer to final concentration of 1500 beads per reaction (33 µl) from each couple.

6. RNA Extraction and Quality Control

RNA is isolated from paraffin embedded or frozen tissue or from body fluids (e.g. blood, urine, sputum etc.). The extraction process is optimized to insure recovery of the short length RNAs as well. At the final stage RNA is diluted in RNase-free sterile distilled deionized water (DDW).

RNA quality is estimated by measuring the RNA concentration in a Nanoprop spectrophotometer (Nanoprop Technologies ND-1000). Residual salts and organic solvents, and residual proteins are evaluated by measuring 260/230 and 260/280 nm wavelength ratios, respectively. Further quality evaluation and degradation is done by agarose (1.2%) and urea-denaturized acrylamide (13%) gels.

7. Small RNA Fraction Enrichment

5 μg of RNA is diluted in 50-150 μl DDW. The RNA is applied onto YM100 column. The column is centrifuged for 25 minutes at 14,000×G, 4° C. (Microcon YM100 filter device; Millipore; Amicon; Cat #42413). The flow-through is then precipitated with 8 μl (50 mg/ml) Glycogen, 10% volume of 3M NaOAc pH 5.2 and 3-4 volumes of 100% cold EtOH, for 1 hr at 80° C. Next, the tubes are centrifuged for 40 minutes at maximal speed, 4° C. The supernatant is discarded and the pellet is washed with 85% cold EtOH. The pellet is dried and re-suspended in DDW. Between 5 and 10% recovery is expected.

8. Chemical Labeling of miRNA Using ULS Technology

Enriched small RNA isolated from 5 μg of total RNA are biotinylated using a MicroMax labeling and detection kit (Perkin-Elmer; Cat# MP5545). "Naked" spikes (control RNA molecules with non-human sequences, 22 nt long) are added as controls for the labeling procedure (5-20 fmol per reaction). 0.5 μl of ASAP biotin reagent and 2.5 μl of ASAP labeling buffer are added. DDW is added to a final volume of 10 μl.

Reactions are well-mixed and incubated in a thermal controller (PCR machine) for 30 minutes at 85° C. and then cooled to 4° C. for 5 minutes. KREApure reaction clean-up columns are pre-warmed to room temperature for 20 minutes. Columns are pre-spun for 1 minute at maximal speed in 2 ml microtubes and placed into fresh 1.5 ml tubes. The labeling reaction is then applied to the top of the column and spun again for 1 minute at maximal speed. Flow-through is collected and may be used for hybridization or stored at −20° C.

9. RNA Hybridization

Each hybridization reaction contains: MicroMax-labeled miRNAs; 1-5 fmol of pre-biotinylated spikes (control RNA molecules with non-human sequence, 22 nt long with a 5' biotin) as hybridization controls; and a mix of LUMINEX® microspheres coupled to miRNA probe nucleic acids (i.e., a mix of coupled beads).

RNA is first diluted with TE (Tris-EDTA buffer pH 8.0; Sigma T-9285) to a final volume of 17 μl. Then a mix of coupled beads is re-suspended by vortexing and sonicating for 20 seconds. 33 μl of mix is added to RNA using 1500 coupled beads per reaction. A tube containing buffer and coupled beads alone (i.e., no RNA) is used as background. Reactions are then mixed and denatured for 5 minutes at 85° C. and subsequently hybridized overnight at 50° C. Hybridization temperatures may be increased up to 55° C. to increase specificity, but it may lower the overall signal.

10. Measurement Via LUMINEX®

Hybridization reactions are transferred to a multiscreen 96-well filter plate (Millipore; Cat# MABVN1210). Vacuum is applied and 75 μl of 20 μg/ml streptavidin-R-phycoerythrin (PhycoLink; Prozyme; Cat# PJ315) diluted in X1 TMAC Hybridization Buffer is added to each well. The suspension is mixed thoroughly and transferred to a 96-well plate (Thermowell 96-well plate, Polycarbonate; Costar 6511).

The plate is placed in a LUMINEX® xMAP reader preheated to 50° C. for 10 minutes and then analyzed by the machine. A dual laser detects bead identity and the quantity of bound material. The LUMINEX® is set to the following specifications: Sample volume: 50 μl; Sample timeout: 100 seconds; Double discrimination gate: 7,500-20,000.

Example 18

High-Throughput Coupling of LNA Probes to LUMINEX® Microspheres

Experiments are performed as in sections 1-6 of Example 17 above, but instead of using the mirVana miRNA probe set, an Exiqon LNA miRNA probe set is used. When LNA probes are used, hybridization to coupled bead mixtures is done at a temperature between 65° C. and 75° C.

Example 19

Sensitivity of DNA Coupled-Bead Probes

To evaluate the sensitivity of detection, "naked" spikes (control RNA molecules with non-human sequences, 22 nt long) at increasing concentrations were added to miRNA biotin labeling reactions performed as described above in Example 17 (Section 4).

Example 20

Sensitivity

Figure 6:
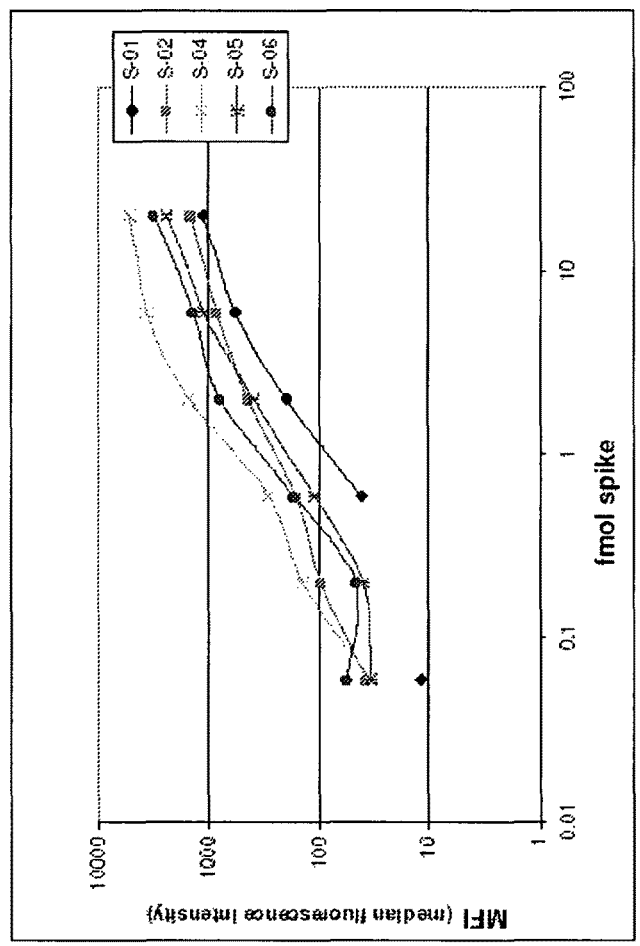
FIG. 6 demonstrates the sensitivity of the LUMINEX® assay as was measured using 5 different Spikes at increasing concentration. Labeling was done using the ULS technology and Ambion probe set was used for bead coupling. The system was found to be sensitive up to 0.06 fmol miRNA and is linear at 2 orders of magnitude. Results are presented on a logarithmic scale.

Spikes at increasing concentration were added to miRNA labeling reaction. An Ambion probe set was used in this experiment. The system was sensitive up to 0.06 fmol miRNA and was linear at 2 orders of magnitude. Results are presented on a logarithmic scale. See FIG. 6.

Figure 7:
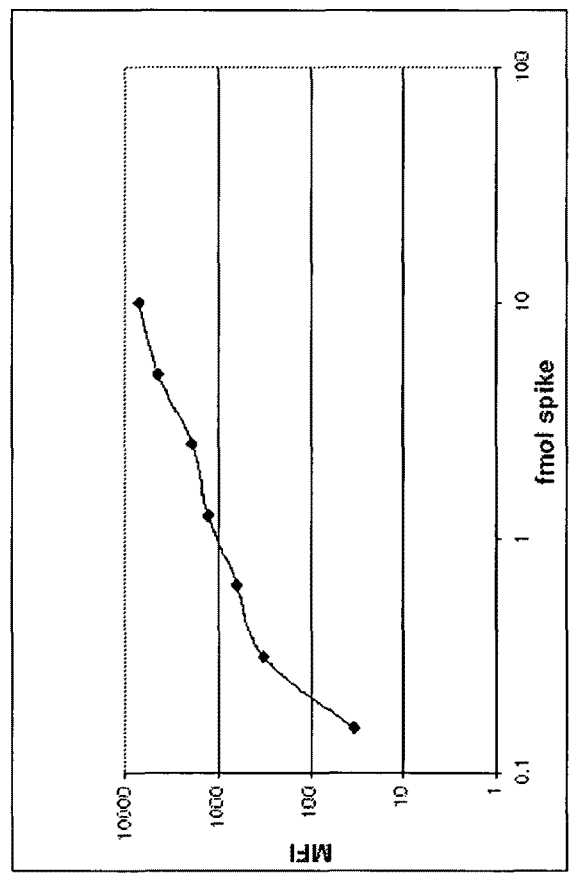
FIG. 7 demonstrates the sensitivity of the assay as was measured using a biotinilated spike at different concentration. Exiqon LNA probe set was used for bead coupling. The system was found to be sensitive up to 0.1 fmol miRNA and is linear in all the examined range, up to 10 fmol. Results are presented on a logarithmic scale.

Biotinylated spike at different concentration was added to miRNA hybridization reaction. Exiqon LNA probe set was used in this experiment. The system was sensitive up to 0.1 fmol miRNA and was linear in all the examined range, up to 10 fmol. Results are presented on a logarithmic scale. See FIG. 7.

Example 21

Specificity

Figure 8:
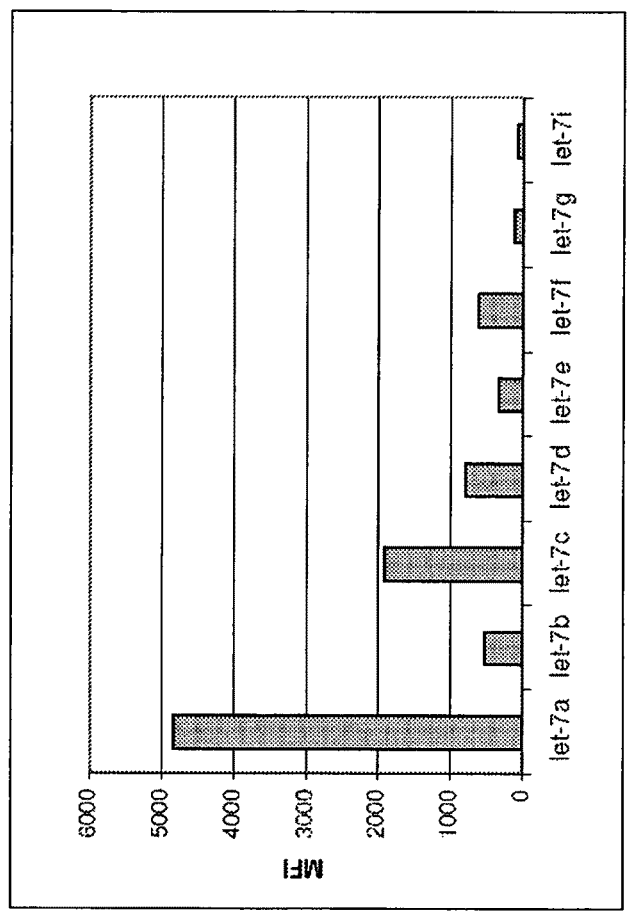
FIG. 8 demonstrates the specificity as was tested using let-7a synthetic miRNA, which was labeled and hybridized with a mixture of bead coupled to different Let-7 family members. The specificity of the system is proportional and correlative to the similarity between the sequences, the number of mismatches, their position in the sequence and the nature of the mismatch (which nt is changed).

Let-7a synthetic miRNA was labeled and hybridized with mix of bead coupled to different Let-7 family members. The specificity of the system was proportional and correlative to the similarity between the sequences, the number of mismatches, their position in the sequence and the nature of the mismatch (i.e., which specific nt was changed). See FIG. 8.

Figure 9:
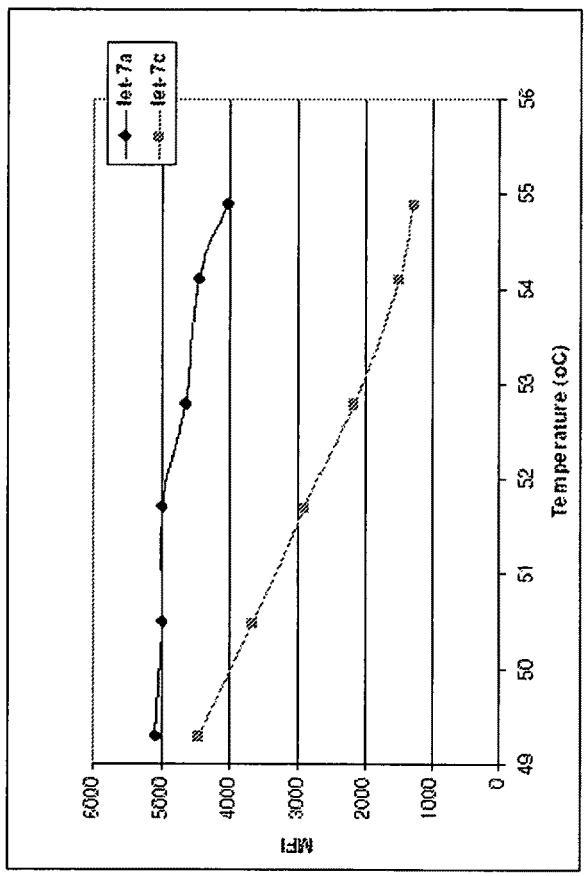
FIG. 9 shows the same specificity test as in FIG. 8 as was performed with increasing hybridization temperatures. Non specific let-7c binding is decreased dramatically with the increase in hybridization temperature, while the specific signal is just slightly affected.

The same experiment was performed with increasing hybridization temperatures. As may be seen in FIG. 9, as hybridization temperature increased, nonspecific let-7c binding decreased dramatically, while the specific signal was just slightly affected.

Example 22

Reproducibility

Figure 10:
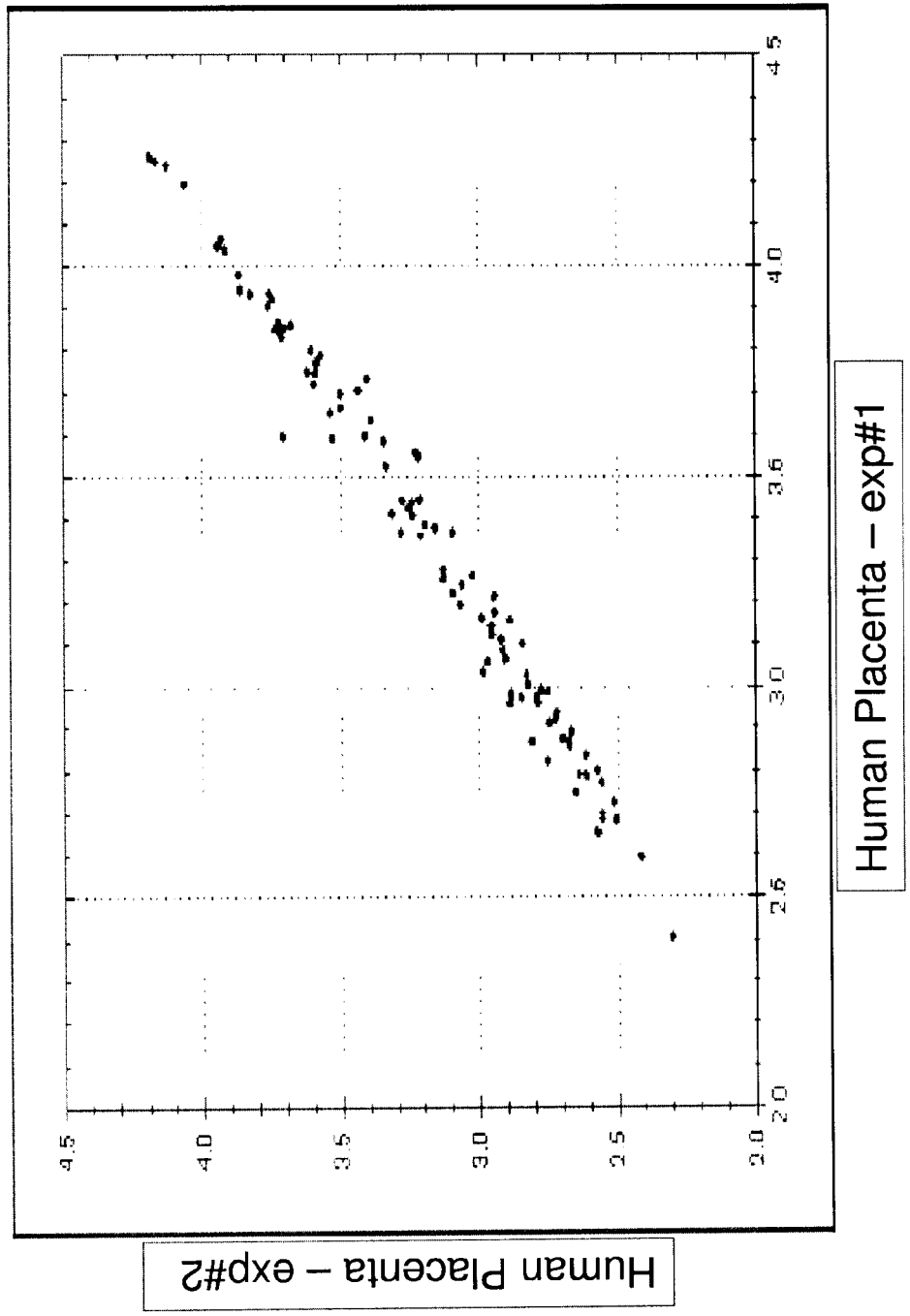
FIG. 10 demonstrates the reproducibility of the labeling and the hybridization. Human placenta RNA was labeled and hybridized in two separate experiments.

Human Placenta was labeled and hybridized as described in Examples 17-19. Reproducibility of two separate experiments is presented in FIG. 10.

Example 23

Tissue Specific miRNA Identification

Brain and placenta RNA from fresh tissue were labeled and hybridized to couple mix. The expression profile of 100 miRNA set is presented FIGS. 11 and 12. miRNAs specific to brain or placenta, as previously described in the literature, were detected and are denoted on the figure. Results are presented on logarithmic scale.

Figure 11:
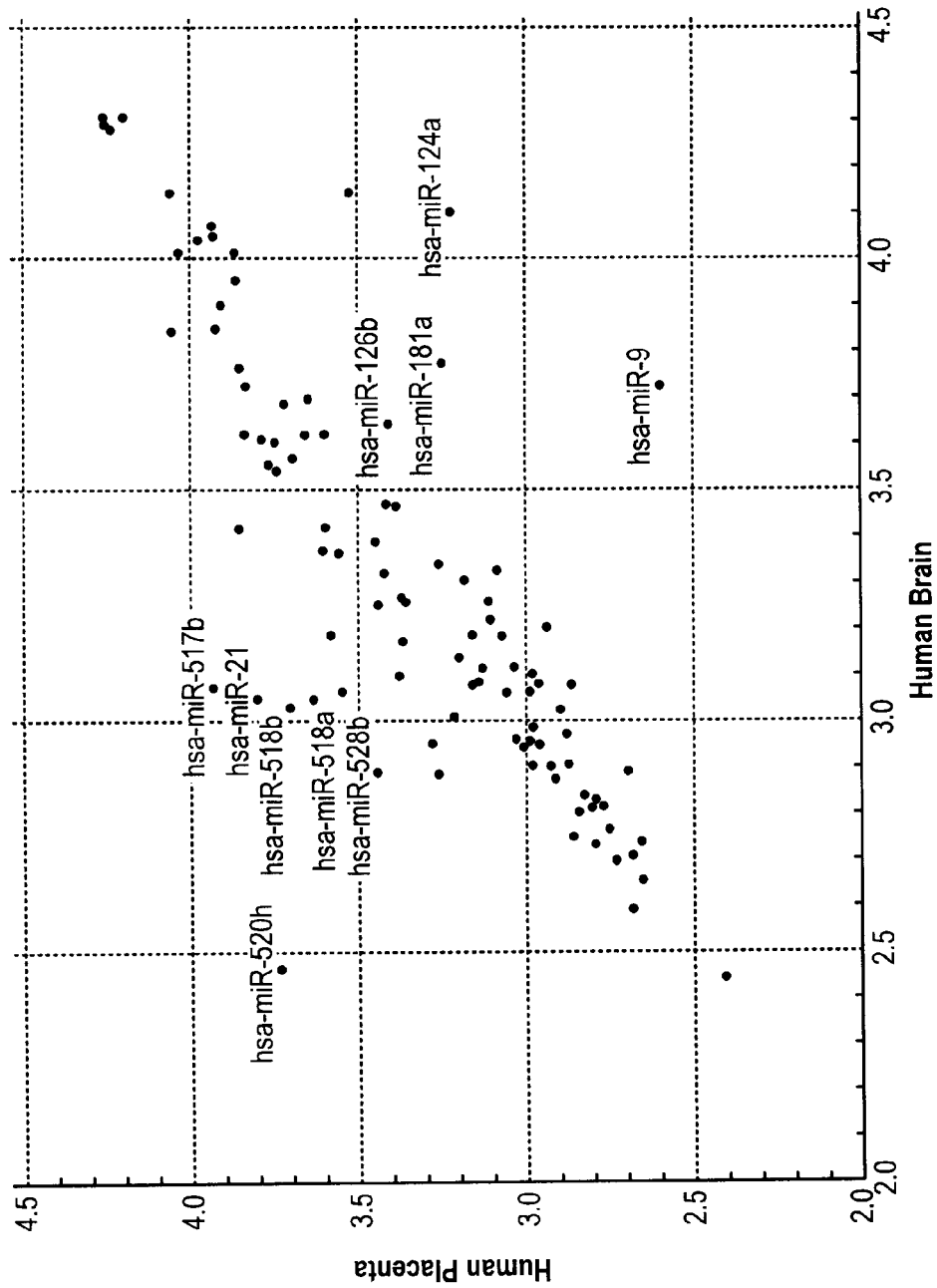
FIG. 11 demonstrates the expression profile of 100 miRNA set. Human brain and placenta RNA from fresh tissue were labeled and hybridized to couple beads having LNA modified probes. miRNAs specific to brain or placenta were detect and are denoted on the figure. Results are presented on logarithmic scale.

FIG. 11 represents binding to LNA modified probes.

Figure 12:
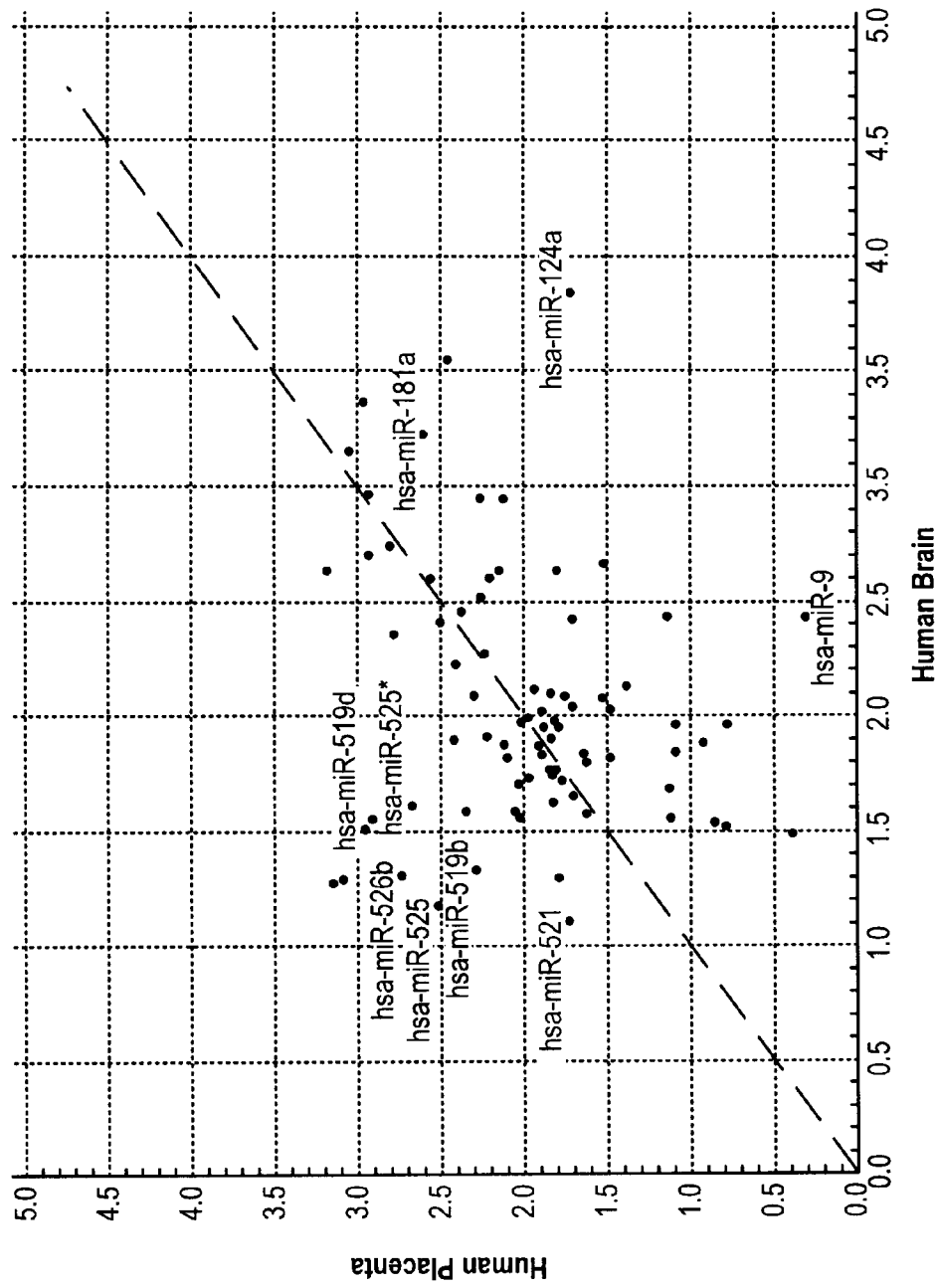
FIG. 12 demonstrates the expression profile of 100 miRNA set. Human brain and placenta RNA from fresh tissue were labeled and hybridized to couple beads having non-modified probes from the Ambion probe set. miRNAs specific to brain or placenta were detect and are denoted on the figure. Results are presented on logarithmic scale.

FIG. 12 represents the binding to non-modified DNA probes from the Ambion probe set.

Example 24

Cancer Tissue miRNA Expression Profiling

Figure 13A:
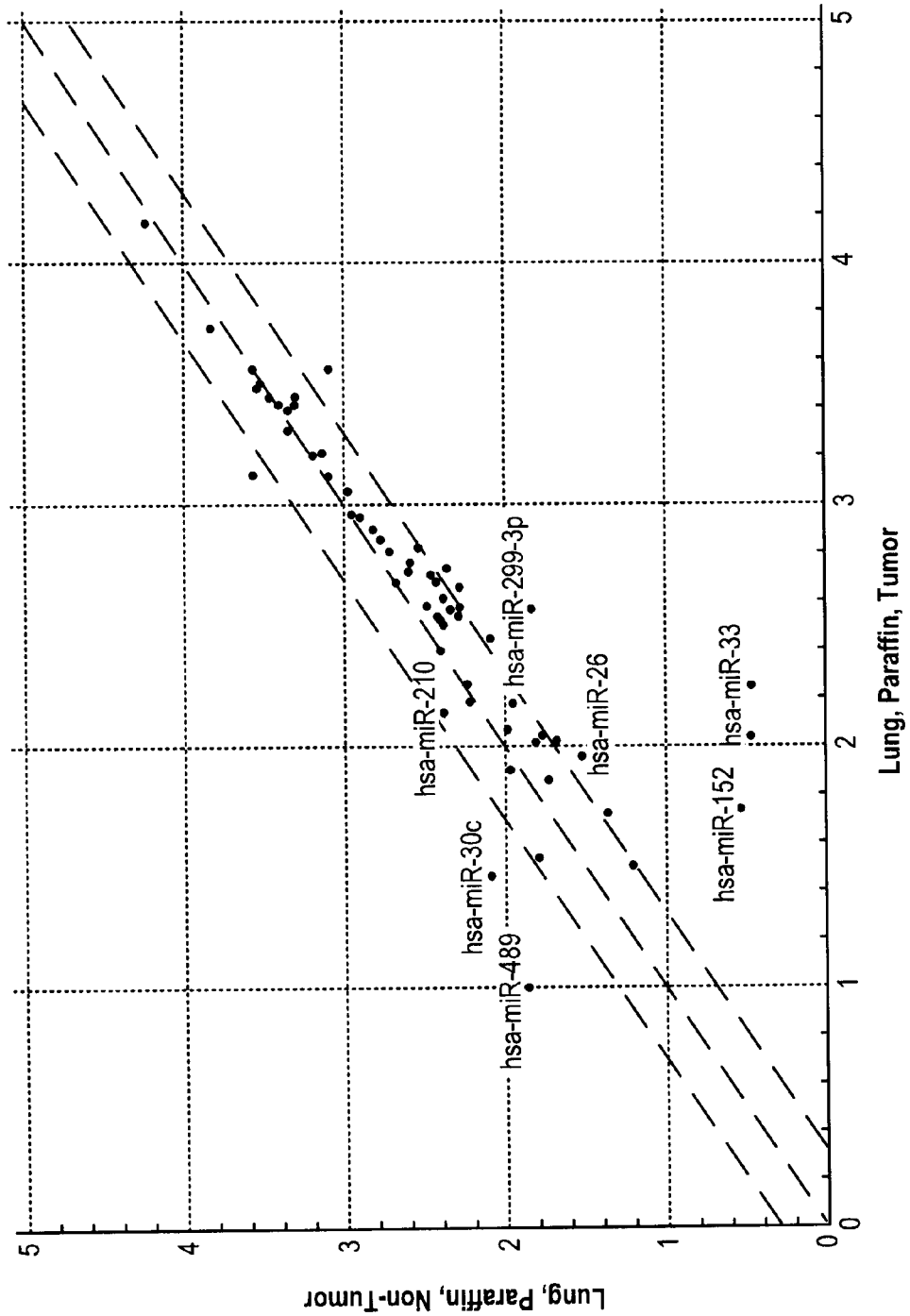
FIGS. 13A-13B demonstrate miRNAs differential expression. The RNA was extracted from formalin fixed paraffin embedded lung (FIG. 13A) and bladder (FIG. 13B) normal and tumor tissues. miRNA expression profile was performed as described. Some miRNAs with differential expression are marked on the graph. Results are presented on logarithmic scale.
Figure 13B:
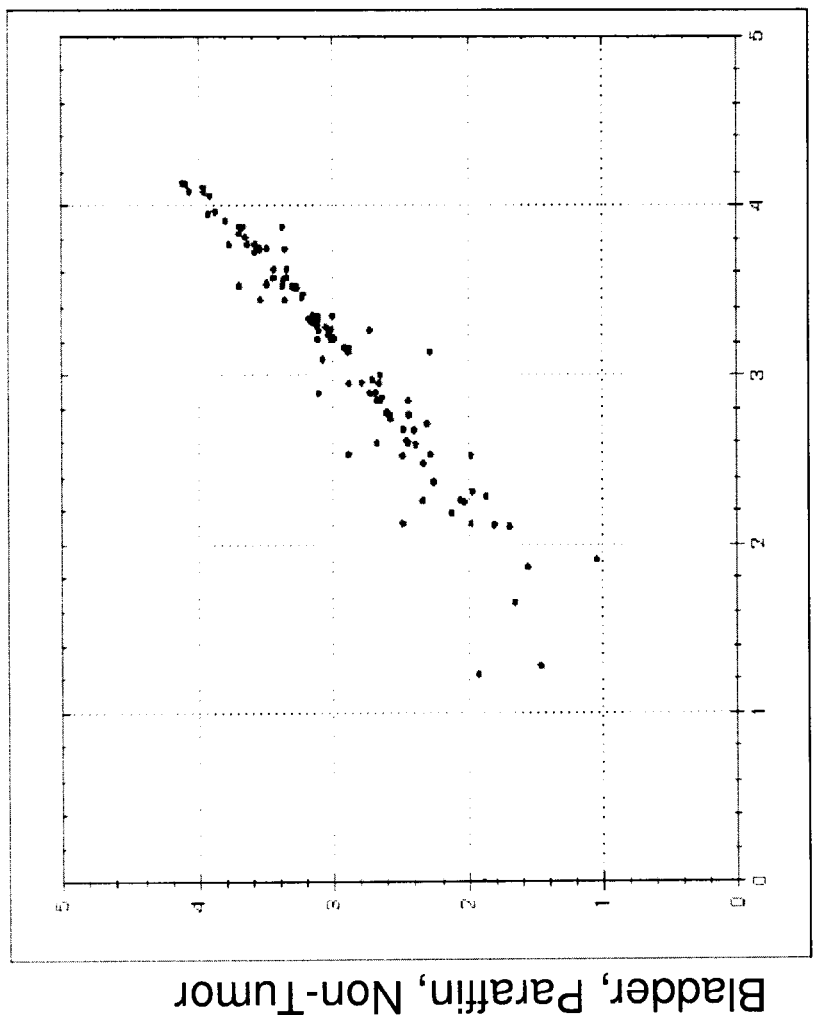

RNA was extracted from formalin fixed paraffin embedded lung and bladder tissues, normal and tumor. miRNA expression profile was performed as described. miRNAs with differential expression are marked on FIGS. 13a-b. The results are presented on logarithmic scale.

Example 25

Detailed Protocols of Other Labeling Methods

1. Direct Labeling
   a. Kreatech Chemical Labeling

The labeling may be performed by ULS Small RNA labeling Kit by Kreatech.

The labeling procedure is similar to what is described above (for PerkinElmer).

An optimal ratio of 1 μl reagent per 50 ng small RNA should be maintained. Preferably, at least 12.5 μg of small RNA should be used in a reaction volume of 10 μl. 1 μl of X10 buffer is added.

b. p-CU-Bio Libations

Enzymatic end labeling of dinucleotide with a biotin entity. Different ligation systems may be used.

(1) Protocol 1: NEB Ligase

| | |
|---|---|
| RNA | 5 μl |
| 3 × Ligation Buffer | 3 μl |
| p-CU-BIO | 1.5 μl |
| DTT 0.1M | 1.5 μl |
| ATP 30 mM | 0.5 μl |
| T4 RNA Ligase (NEB) | 1.5 μl |
| DDW | 2 μl |
| Total Volume | 15 μl |

Incubation for 2 hr at 30° C., following by inactivation for 3 min at 80° C. and O.N. precipitation: Increase volume to 150 μl, add 8 μl glycogen, 15 μl NaOAc, 550 μl 100% EtOH.

Resuspend in 5 μl DDW. Before LUMINEX® add 12 μl TE (final volume 17 μl).

Example 26

Signal Amplification Methods

1. Protocol for TSA (Tyramide Signal Amplification)
   Before Starting:
   1. Re-suspend bioinyl-Tyramide in 0.3 ml DMSO—stock solution (stable at 4° C. for six months).
   2. Dilute stock solution 1:50 using X1 amplification buffer (working solution).
   3. Prepare TNT wash buffer: 0.1M Tris-HCl (pH 7.5), 0.15M NaCl, 0.05% Tween-20.
   4. Prepare TNB blocking buffer: 0.1M Tris-HCl (pH=7.5), 0.15M NaCl, 0.5% blocking reagent.
      Stir and heat (not exceeding 60° C.) for complete dissolution.
      Filter solution, aliquot and store at 4° C.

Procedure:
1. Microspheres coupling, miRNA chemical labeling and hybridization are performed as described above.
2. Wash hybridization reaction by spinning down the sample
3. Resuspend in 100 ul blocking buffer TNB
4. Incubate 30 minutes at RT
5. Spin
6. Resuspend with 100 ul SA-HRP, diluted 1:100 in TNB.
7. Incubate 30 minutes at RT.
8. Load onto Millipore filter plates.
9. Wash ×3 with TNT buffer (apply vacuum and resuspend X3)
10. Add 100 μl of biotinyl-Tyramide working solution (dilute stock solution 1:50 using X1 amplification buffer-working solution).
11. Mix by pipetting up and down.
12. Incubate for 10 minutes at RT
13. Wash with TNT ×3 (as in 10).
14. Add SA-PE 75 ul of 20 ug/ml in TMAC.
15. Incubate 10 minutes at 50° C.
16. Read in LUMINEX®.

Figure 14:
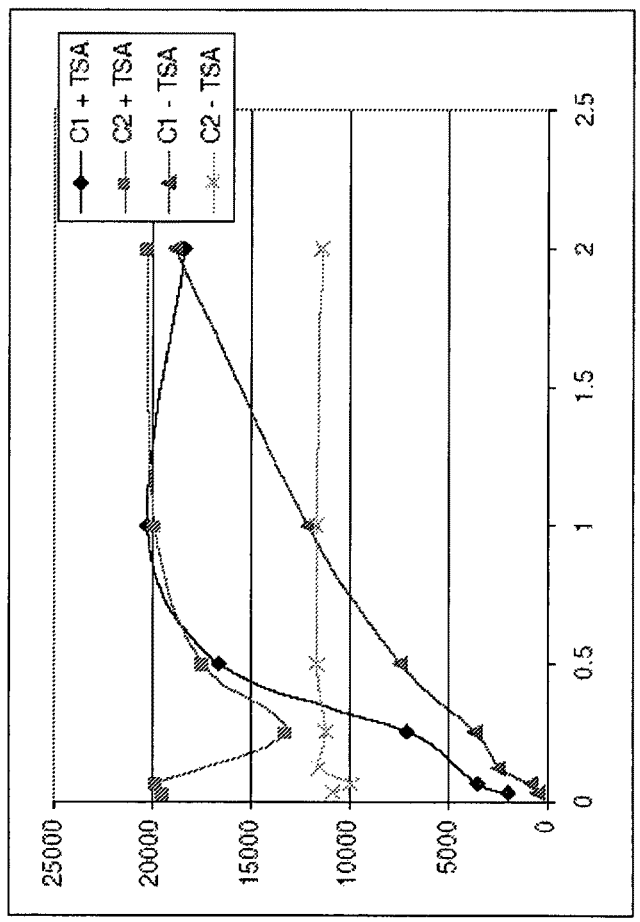
FIG. 14 demonstrates the Tyramide signal amplification (TSA) reaction as was performed onto 2 biotinilated spikes, one of which with increasing concentration (C1) and the other at a constant concentration (C2). The results of both signal; with and without TSA are presented.

FIG. 14 shows how the TSA reaction amplifies of biotinylated spikes

2. Signal Amplification by Genisphere

Protocol for the use of Genisphere signal amplification kit onto the LUMINEX® platform. (Protocol as provided by Genisphere)

1. Enrich miRNA fraction by placing total RNA onto YM-100 column.
   a. Poly (A) Tailing of microRNA:
2. 
   a. Add naked spikes to enriched fraction of miRNA.
   b. Adjust the volume of enriched microRNA and spikes to 15.5 μl with Nuclease Free Water (Vial 10). Depending on the array quality, 50 ng to 500 ng of enriched microRNA will be required to produce quality data.
   c. Dilute the ATP (Vial 4) in 1 mM Tris pH 8.0 according to the following formula:

$$\text{ATP dilution factor} = \frac{5000}{ng \text{ of micro } RNA}$$

3. Add the following components to the 15.5 μl microRNA, for a volume of 25 μl:
   a. 5 μl 5×miRNA Reaction Buffer (Vial 2)
   b. 2.5 μl MnCl2 (Vial 3)
   c. 1 μl diluted ATP (Vial 4 dilution from step 2)
   d. 1 μl PAP Enzyme (Vial 5)
4. Mix gently and microfuge.
5. Incubate in a 37° C. heat block for 15 minutes.
   b. Ligation of "cplCap03" Capture Sequence to the Tailed microRNA
6. Briefly microfuge the 25 μl of tailed microRNA.
7. Add the following components at room temperature for a volume of 36 μl:
   a. 6 μl 6×"cplCap03" Ligation Mix (Vial 9)
   b. 2 μl T4 DNA Ligase (Vial 8)
   c. 3 μl Nuclease Free Water (Vial 10)
8. Mix gently and microfuge.
9. Incubate at room temperature (20-28° C.) for 30 minutes.
10. Stop the reaction by adding 4 μl of 0.5M EDTA pH 8. Briefly vortex and microfuge.

11. Add 60 μl of 1×TE Buffer for a final volume of 100 μl. Briefly vortex and microfuge. This is the Tagged microRNA.
   c. Purification of Tagged microRNA
12. Purify the 100 μl of Tagged microRNA using the MinElute PCR Purification Kit (Qiagen cat. no. 28006) as follows:
   a. Add 500 μl Buffer PB to the 100 μl sample and vortex. Briefly microfuge.
   b. Apply the mixture to the MinElute column and centrifuge for 1 minute at 10-14,000×g (~13,000 rpm) in a conventional tabletop microcentrifuge
   c. Discard the flow-through. Place the MinElute column into the same collection tube
   d. Add 750 μl Buffer PE to the MinElute column and centrifuge for 1 minute.
   e. Discard the flow-through. Place the MinElute column back into the same collection tube
   f. Centrifuge for 2 minutes to remove residual PE buffer
   g. Place the MinElute column into a clean, labeled, 1.5 mL microfuge tube
   h. Add 10 μl Buffer EB to the center of the column membrane. Incubate at room temperature for 2 minutes. Centrifuge for 2 minutes. Discard column and save the 10 μl eluate. This is the Tagged microRNA.
   d. LUMINEX® Bead Binding and Detection Assay Using Tagged LMW RNA
1. Select the appropriate coupled LUMINEX® bead sets (mix).
2. Vortex the coupled beads by vortexing for 10-20 secs.
3. Prepare a working LUMINEX® bead mixture by diluting the coupled LUMINEX® bead stocks to 1500 LUMINEX® beads (per each bead type) per run in 1.5×TMAC (4.5M TMAC) with or without formamide. (Note: 33 uL total of working LUMINEX® bead mixture is required for each reaction.) 10-30% Formamide may be added to the TMAC solution to increase the stringency of the hybridization. Vortex the beads in the TMAC buffer.
4. Add 33 μL of the LUMINEX® bead mixture (from step 3 above) to a nuclease free 0.2 ml strip PCR tube with cap (ISC Bioexpress Cat # T-3034-1).
5. To each tube add 17 uL of tagged LMW RNA's (from the protocol above) diluted in 1×TE pH 8.0 including the appropriate bio-spikes. Add the equivalent of 20-150 ng of LMW RNA (as measured prior to tagging procedure). Incubate for 16 hours at 50° C. (65° C. if probes are LNA) with shaking at 300 RPM.
6. Transfer the entire reaction from each tube to the wells of a pre-wetted (with 1×PBS) Multiscreen-BV filter plate (Millipore cat# MABVN1210).
7. Wash the beads (in the filter plate) once with 1×TMAC (pre-warmed to 50° C.) using a vacuum manifold.
8. Add 50 μL of biotinylated Cap03 dendrimer diluted to 1.0 ng/uL in Genisphere's Binding Buffer 1. Incubate at 37° C. for 2 hours with shaking at 300 RPM.
9. Wash the beads once with 1×TMAC pre-warmed to 50° C.
10. Add 50 uL of SA-PE (ProZyme) diluted to 20 ng/uL in 1×PBS. Incubate for 30 minutes at 37° C. with shaking at 300 RPM.
11. Wash the beads 1× with 1×PBS.
12. Add 75 μL of 1×PBS to each well and transfer the contents of the well to a separate microtiter plate.
13. Analyze on the LUMINEX® 100 calibrated at the low RPI calibration.

Optional:
Anti-PE Biotin (Dendrimer) Reagent
We used this dendrimer reagent for further improving the sensitivity of the miRNA LUMINEX® assays, which has resulted in the successful use of as little as 1-3 ng of LMW RNA (equivalent to 50-150 ng total RNA) per multiplex bead assay (6-12 plexes) in our hands. The additional steps for the use of the anti-PE dendrimer reagents are rather simple, and are added to the end of the current miRNA LUMINEX® protocol (following Step II of the current protocol):

Step 12. Dilute the anti-PE biotin dendrimer in Binding Buffer I by adding 5.5 uL of the anti-PE biotin (dendrimer) reagent to 49.5 uL of Binding Buffer I for every bead reaction (microtiter well) desired.

Add 50 uL of the diluted anti-PE biotin dendrimer to each bead reaction in the filter microtiter plate, and incubate at RT for 60 minutes with shaking at 300 RPM.

Step 13. Wash the beads 1× with 1×PBS.
Step 14. Dilute the 50×SA-PE with 1×PBS. Add 50 uL of diluted SA-PE per well, vortex the plate for 5 seconds. Incubate for 30 minutes at 37° C. with shaking at 300 RPM.
Step 15. Wash the beads 1× with 1×PBS.
Step 16. Add 150 uL of 1×PBS to each well. Pipet the beads up and down to mix 5-6 times, then transfer the contents of the well to a separate microtiter plate.
Step 17. Analyze on the LUMINEX® instrument.

Example 27

Transcription Methods

1. Direct Transcript
If this possibility is to be used a sense probe set of the miRNA should be coupled to the microspheres.
Direct transcript labeling method includes the ligation of a RNA; DNA hybride adaptor and the transcription using biotinilated nucleotides.
   1. Prepare the following reaction mixture:

|  | Volume | From stock | Comments |
|---|---|---|---|
| RNA | 5 μl | 1 ug/ul | RNA is after YM-100 |
| Spike 1 - S-01-RNA-S | 2 μl |  | 100 fmol |
| Spike 2 - S-02-RNA-S | mix of both |  | 25 fmol (or create a mix with appropriate fmol of both spikes in 2 ul). |
| 10 × Ligation Buffer | 2.5 μl |  | From NEB |
| Adaptor | 2 μl | 100 p/ul | Box-3-8 19578175 3ada-DT-avrII |
| DMSO | 3.7 μl |  |  |
| RNasine (HPR-1) | 1 μl | 40 U/ul |  |
| T4 RNA Ligase | 1.5 μl |  | Amersham |
| DDW | 8.3 μl |  |  |
| Total Vol | 25 μl |  |  |

2. Incubate at 40 min at 37° C.
   3. Stop reaction by addition of 0.5-2 volumes (12.5 ul) of loading mix (SB Urea) and than run on two phase Acrylamide Urea gel (i.e. 6% top, 13% bottom).
   4. Run on 200 volt 80 mA ~55 min. Cut the slice out of the gel according to RNA markers, between the free adaptor and small RNA.
   5. Elute the RNA by midi GeBAflex-into 0.8 ml DDW (cut off 3500) 120 volt 40 min, and than reverse the polarity of the electric current for 120 seconds.

6. Precipitate the RNA by adding 8 μl glycogen (5 mg/ml) to 400 μl RNA, 1/10 volume NaoAc and 3-4 volume cold ethanol 100%. Keep O/N at −20° C.
7. Spin at max speed for 40 min, and wash with 85% ethanol. Resuspend in 3 μl. (If two tubes are used, resuspend one for 3 minutes at 65° C. and transfer to the second, wash first tube with 2 ul and pool).
8. Add annealing primer—1 ul of probe 19578176 RT-DT-T7 avrII-short from stock 20 p/ul. Perform step wise annealing.

Prepare Transcript Using the T7-MEGAshortscript Kit:
1. Thaw the T7 10× Reaction Buffer, ribonucleotide solutions at room temperature. Keep the T7 Enzyme Mix on ice. Assemble the reaction at room temperature.
2. Prepare reaction mix according to the following:

|  | Volume | From Stock | Comments |
| --- | --- | --- | --- |
| Template | 4 μl | | |
| T7 10X Reaction Buffer | 1 μl | | |
| T7 ATP Solution (75 mM) | 1 μl | | |
| T7 CTP Solution (75 mM) | 1 μl | | |
| T7 UTP Solution (75 mM) | 0.5 μl | | |
| T7 GTP Solution (75 mM) | 1 μl | | |
| UTP Bio | 0.5 μl | | |
| T7 Enzyme Mix | 1 μl | | |
| Total Volume | 10 μl | | |

3. Incubate the reaction at 37° C. O.N.
4. Spin shortly.
5. To remove the DNA template add:
   1 μl of DNase I., mix well, incubate at 37° C. for 15 min.
6. Acid Phenol:chloroform extraction
   Add: 125 μl nuclease-free water, 15 μl 3 M sodium acetate, and 150 μl Acid Phenol:chloroform. Mix thoroughly. Spin at max speed for 10 min.
7. Precipitate the RNA:
   Mix top phase in new tube with 8 μl glycogen (5 mg/ml), 3.6 volume ethanol (550 μl) Keep O/N at −20° C. (or 2 h at −80 C), Centrifuge max 40 min, Wash with 85% ethanol. and resuspend in 25 μl.
8. Concentration:
   Determine concentration.
9. Purify from free nucleotides.
   Load transcripts on G-25 column.
10. Add bio-RNA spike for hybridization control:
    C-lin4-bio-AS-RNA 5f
    C-mir2-bio-AS-RNA 1f For Hybridization with LUMINEX® Mix Couples Use:
1. 5 μg transcripts, or
2. 0.5 μg purified transcripts.

Example 28

Amplification of microRNA Using SenseAmp Plus™—Genisphere

1. Procedure (Starting from Total RNA)
   a. Enrichment and Concentration of microRNA:
   Microcon YM-100 column (Millipore cat. no. 42413) and a conventional tabletop microfuge.
   Dilute the total RNA sample to 100 μl with 10 mM Tris-HCl, pH 8.0.
   Add the 100 μl of diluted total RNA to the sample reservoir. Do not touch the membrane with the pipette tip. Secure the tube cap and centrifuge for 6 minutes at 13,000 g.
   Save the flow-through material (~95 μl). This is your LMW RNA having an average size less than 80-100 bases long.
   Concentration:
   Microcon YM-3 column (Millipore cat. no. 42404) and a conventional tabletop microfuge.
   Add the LMW RNA from step 3 above (~95 μl flow-through of YM-100) to the YM-3 sample reservoir. Do not touch the membrane with the pipette tip. Secure the tube cap and centrifuge for 30 minutes at 13,000 g.
   Check the volume of the flow-through and continue the centrifugation until the flow-through volume is equal to the loaded volume (~95 μl) minus 6-8 μl or no additional liquid is accumulated in the lower reservoir. For example, if 95 μl was loaded on the YM-3 then the flow through measure 87-89 μl.
   Add 10 μl of 10 mM Tris-HCl, pH 8.0 to the sample reservoir and gently mix by tapping the side.
   Carefully place the sample reservoir upside down in a new collection tube. Centrifuge for 3 minutes at 13,000 g to collect the concentrated LMW RNA. Proceed to the Poly (A) Tailing of microRNA section below.
   b. Poly (A) Tailing of microRNA
   Adjust the volume to 18 ml with Nuclease Free Water (Vial 10).
   Dilute the ATP (Vial 14) in 1 mM Tris pH 8.0 according to the following formula:

$$ATP \text{ dilution factor} = \frac{250000}{ng \text{ of Total } RNA \text{ (into the } YM100 \text{ above)}}$$

For example, if starting with 2000 ng miRNA, the ATP dilution factor=250000÷2000 ng=125.
Dilute the ATP 1:125 by adding 1 ml of ATP (Vial 14) to 125 ml of 1 mM Tris pH 8.0.
For samples less than 50 ng of total RNA: dilute the ATP (Vial 14) 1:5000 in 1 mM Tris pH 8.0.
Add the following components to the 18 ml microRNA, for a volume of 25 ml:
2.5 ml 10× Reaction Buffer (Vial 6)
2.5 ml 25 mM MnCl2 (Vial 17)
1 ml diluted ATP (Vial 14 dilution from step 2)
1 ml PAP Enzyme (Vial 16)
Mix gently and microfuge.
Incubate in a 37° C. heat block for 15 minutes.
Reverse Transcription of Tailed microRNA
Briefly microfuge the 25 ml of tailed microRNA and place on ice.
Prepare a 1:10 dilution of SenseAmp dT primer (Vial 1) by adding 1 ml SenseAmp dT primer to 9 ml 0.1×TE. Vortex and briefly microfuge.
On ice, add 2 ml of 1:10 diluted SenseAmp dT primer (Vial 1 dilution from step 2).
Mix gently and microfuge.
Incubate at 65° C. for 10 minutes and immediately transfer to ice for 2 minutes.
Add the following components on ice, for a volume of 50 ml:
10 ml 5× First Strand Buffer (or equivalent buffer supplied with the reverse transcriptase)
5 ml 0.1M DTT (If supplied with the reverse transcriptase; otherwise use nuclease free water)
2.5 ml dNTP mix (Vial 3)
1 ml Superase-in™ RNase inhibitor (Vial 4)
2 ml SuperScript II reverse transcriptase, 200 units (or equivalent reverse transcriptase)
2.5 ml Nuclease Free Water (Vial 10)

Gently mix (do not vortex) and incubate at 42° C. for one hour.

Stop the reaction by adding 8.75 ml of 0.5M NaOH/50 mM EDTA. Briefly vortex and microfuge.

Note: the reaction may turn to a brown color; this is normal. Incubate at 65° C. for 30 minutes to degrade the miRNA.

Note: the reaction may turn from brown to clear; this is normal.

Neutralize the reaction with 12.5 ml of 1M Tris pH 8.0. This is the cDNA. Briefly vortex and microfuge. Bring the sample to 100 ml by adding 28.75 ml 1×TE Buffer.

c. Purification and Concentration of cDNA

Purify the 100 μl of cDNA using a Microcon YM-100 column (Millipore cat. no. 42413) and a conventional tabletop microfuge.

Add the 100 μl cDNA to the sample reservoir. Do not touch the membrane with the pipette tip. Secure the tube cap and centrifuge for 6 minutes at 13,000 g.

Add 200 μl of 1×TE buffer to the sample reservoir without touching the membrane. Gently mix by pipetting up and down 5 times. Secure the tube cap and centrifuge for 6 minutes at 13,000 g.

Carefully separate the sample reservoir from the collection tube. Discard the flow-through. Place the YM-100 column into the same collection tube.

Add 200 μl of 1×TE buffer to the sample reservoir without touching the membrane. Gently mix by pipetting up and down 5 times. Secure the tube cap and centrifuge for 6 minutes at 13,000 g.

Carefully separate the sample reservoir from the collection tube. Discard the collection tube.

Add 5 μl 1 mM Tris pH 8.0 to the sample reservoir without touching the membrane. Gently tap the side of the reservoir to mix.

Carefully place the sample reservoir upside down in a new collection tube. Centrifuge for 3 minutes at 13,000 g.

Note the volume of cDNA collected in the bottom of the tube (5-10 μl). Bring the volume of cDNA to 10 μl with Nuclease Free Water (Vial 10).

Tailing of First Strand cDNA

Heat purified cDNA (10 ml) to 80° C. for 10 minutes. Put on ice immediately for 1-2 minutes. Briefly microfuge and return to ice.

For each reaction, prepare a Master Mix (10 ml) in a separate tube on ice:
2 ml 10× Reaction Buffer (Vial 6)
2 ml Nuclease Free Water (Vial 10)
4 ml 10 mM dTTP (Vial 5)
2 ml TdT Enzyme (Vial 7)

Combine the Master Mix and the cDNA for a volume of 20 ml. Mix gently and microfuge.

Incubate in a 37° C. heat block for 3 minutes. Do not exceed 3 minutes.

Stop the reaction by heating to 80° C. for 10 minutes. Briefly microfuge and cool to room temperature for 1-2 minutes.

d. T7 Promoter Synthesis

Add 2 ml of SenseAmp T7 Template Oligo (Vial 8) to the tailed cDNA for a volume of 22 ml. Briefly vortex and microfuge.

Incubate at 37° C. for 10 minutes to anneal the strands.

To each reaction, add the following components for a volume of 25 ml:
1 ml 10× Reaction Buffer (Vial 6)
1 ml dNTP mix (Vial 3)
1 ml Klenow Enzyme (Vial 9)

Mix gently and microfuge. Incubate at room temperature for 30 minutes.

Stop the reaction by heating to 65° C. for 10 minutes. Place on ice.

Proceed to the In Vitro Transcription reaction using half (12.5 ml) of the promoter-modified cDNA. Save the remaining modified cDNA at −20° C. for future use or for use in a parallel amplification reaction.

e. In Vitro Transcription

Incubate the 12.5 ml of cDNA at 37° C. for 10 minutes to re-anneal the strands.

Thaw the T7 Nucleotide Mix (Vial 11) and 10×T7 Reaction Buffer (Vial 12) at room temperature, and keep at room temperature until use. Thoroughly vortex the 10×T7 Reaction Buffer (Vial 12) to avoid precipitation of certain buffer components.

For each reaction, add the following components to the 12.5 ml of cDNA at room temperature, for a final volume of 25 ml:
8.0 ml T7 Nucleotide Mix (Vial 11)
2.5 ml 10×T7 Reaction Buffer (Vial 12)
2.0 ml T7 Enzyme Mix (Vial 13)

Mix gently and microfuge. Incubate in a themalcycler (with heated lid) at 37° C. for 4-16 hours. Or, place the reaction in a 37° C. heat block for 5 minutes and then transfer to a 37° C. air hybridization oven for 4-16 hours. It is essential to avoid evaporation and condensation of the reaction during this step.

f. Purification of senseRNA

Purify the senseRNA using the RNeasy MinElute Kit (Qiagen cat. no. 74204) following Qiagen's protocol for RNA Cleanup. To elute, add 14 ml Nuclease Free Water, incubate for two minutes, and then spin. The recovered volume should be approximately 12 ml.

g. Quantitation of senseRNA

Determine the concentration of the senseRNA using the RiboGreen RNA Quantitation Kit (Molecular Probes cat. no. R-11490). Use the Ribosomal RNA standard provided with the kit to prepare a standard curve. Use 1 μl of the purified senseRNA to quantitate. Be sure to use an appropriate reference "blank" sample to avoid inaccurate concentration determination.

Example 29

High Throughput Coupling of Probes to Beads—Using EDC

Buffers: MES buffer, 0.1M (pH=4.5), Tween-20, 0.02%, SDS, 0.1%, TE (pH=8.0)

1. Coupling Protocol

Coupling is preformed between carboxylated beads and amine modified probes using EDC.

Coupling is performed in tubes and washed using a 96 multiwell filter plate, resistant for detergents (Solvinert by Millipore).

1. Re-suspended all probes in DDW to a final concentration of 1 mM.
2. Prepare a 1:10 dilution of all probes in DDW (0.1 mM)
3. EDC aliquots powder should reach room temp.
4. Prepare a coupling table of the coupling reactions to performed.
5. Prepare a set of designated tubes.
6. Re-suspend beads by vortex and sonication for about 20 seconds in original tube.
7. Transfer 200 ul from each bead type to the new designated tube (2.5×10$^6$ beads).

8. Spin at max speed for 2 minutes
9. Remove sup and re-suspend in 25 ul MES pH=4.5. Vortex and sonicate for 20 seconds.
10. Add 1 ul of diluted probe to bead. Use pre-made table to get the appropriate bead probe couple.
11. Mix by vortex.
12. Prepare EDC by suspending 10 mg aliquot with 1 ml DDW to create concentration of 10 mg/ml.
13. Add 1.5 ul of EDC to each couple reaction, vortex.
14. Incubate at room temp, in dark 30 minutes.
15. Prepare a new suspended EDC aliquot.
16. Add 1.5 ul of fresh EDC again to each, vortex.
17. Incubate at room temp, in dark 30 minutes.
18. Pre-wet Solvinert filter plates with 100 µl water. (Millipore).
19. Transfer content of couples from tubes to filter plate according to pre-made table.
20. Add 150 µl of 0.02% Tween-20 to the couple's reaction.
21. Place plate onto vacuum apparatus and apply vacuum.
22. Add 150 µl of 0.02% Tween-20 again to the couple's reaction.
23. Apply vacuum again.
24. Add 150 µl of 0.1% SDS, and apply vacuum.
25. Add 150 µl of 0.1% SDS again, and apply vacuum again.
26. Re-suspend coupled beads in 50 µl TE, pH=8.0, mix by pipeting up and down.
27. Transfer couples to a new 96 well plate (no filter), or to new tubes and keep at 4° C.

2. Chemical Labeling of miRNA—MicroMax ASAP (Accurate, Sensitive, and Precise) Labeling Kit
Procedure
1. Small RNA is isolated from 5 µg total RNA by YM-100.
2. Add naked spikes set.
3. Add 0.5 µl ASAP biotin reagent
4. Add 2.5 µl ASAP labeling buffer.
5. Add DDW to final volume of 10 µl
6. Mix by pipetting.
7. Incubate for 30 minutes at 85° C.
8. Cool to 4° C. for 5 minutes (use PCR machine).
9. Purify labeled miRNA using the Kreapure columns:
  a. Let columns reach room temp (20 minutes)
  b. Shake to pull resin to the bottom
  c. Break the bottom and place in 2 ml microtube.
  d. Loosen the cap and pre-spin for 1 minute 14,000 rpm.
  e. Place the column in a fresh microtube
  f. Apply the labeling reaction on top of the raisin bed.
  g. Spin at 14,000 for 1 minute.
  h. Collect the flow through and store at −20° C. or use from hybridization.

3. LUMINEX® Hybridization Protocol
17 ul Labeled Material:

| Labeled RNA | +33ul Mix beads |
| 2ul Bio-Spikes | (in X1.5 TMAC). 1500 beads/reaction |

Complete volume to 17ul with X1 TE

1. Resuspend microspheres by vortex and sonication for approximately 20 seconds.
2. To each sample or background well add 33 µL of Working Microsphere mix. Reaction is preformed in 0.5 ml tubes.
3. To each background well add 17 µL TE, pH 8.
4. To each sample well add examined material that includes labeling and pre-biotinelated spikes, and add TE pH 8.0 to a total volume of 17 µL.
5. Mix reaction wells gently by pipetting up and down several times.
6. Place tubes in PCR-100 machine (Programmable Thermal controller) at 85° C. for 5 minutes to denature any secondary structure in the sample. Incubate the reaction tubes at 50° C. (hybridization temperature) over night.
7. Transfer the samples into 96 well filter plate. Apply vacuum.
8. Prepare fresh reporter mix by diluting streptavidin-R-phycoerythrin sample (PhycoLink-SteptAvidin. Cat# PJ315) to 20 µg/ml in 1×TMAC Hybridization Buffer.
9. Add 75 µl of reporter mix to each well and mix gently by pipetting up and down several times, and transfer to PCR plate. 10. Return the sample plate to hybridization temperature 50° C. in LUMINEX® machine for 10 minutes.
11. Analyze 50 µl at hybridization temperature on the LUMINEX® analyzer according to the system manual.

REFERENCES

1. Chen C, Ridzon D A, Broomer A J, Zhou Z, Lee D H, Nguyen J T, Barbisin M, Xu N L, Mahuvakar V R, Andersen M R, Lao K Q, Livak K J, Guegler K J. Real-time quantification of microRNAs by stem-loop RT-PCR. Nucleic Acids Res. 2005 Nov. 27; 33(20):e179.
2. Fu H J, Zhu J, Yang M, Zhang Z Y, Tie Y, Jiang H, Sun Z X, Zheng X F. A novel method to monitor the expression of microRNAs. Mol. Biotechnol. 2006 March; 32(3): 197-204.
3. Shi R, Chiang V L. Facile means for quantifying microRNA expression by real-time PCR. Biotechniques. 2005 October; 39(4):519-25.
4. Tang F, Hajkova P, Barton S C, Lao K, Surani M A. MicroRNA expression profiling of single whole embryonic stem cells. Nucleic Acids Res. 2006 Jan. 24; 34(2):e9.

SEQUENCE LISTING (21073 sequences)

SEQ ID NO: 1 - RNA, 23 nt, Anopheles gambiae
ugagaucacuuugaaagcugauu

SEQ ID NO: 2 - RNA, 21 nt, Anopheles gambiae
ugagguaguugguuguauagu

SEQ ID NO: 3 - RNA, 22 nt, Anopheles gambiae
uggaauguaaagaaguauggag

SEQ ID NO: 4 - RNA, 21 nt, Anopheles gambiae
acccuguagauccgaauuugu

SEQ ID NO: 5 - RNA, 22 nt, Anopheles gambiae
aacccguagauccgaacuugug

SEQ ID NO: 6 - RNA, 23 nt, Anopheles gambiae
uaaggcacgcggugaaugccaag

SEQ ID NO: 7 - RNA, 22 nt, Anopheles gambiae
ucccugagacccuaacuuguga

SEQ ID NO: 8 - RNA, 22 nt, Anopheles gambiae
uugguccccuucaaccagcugu

SEQ ID NO: 9 - RNA, 22 nt, Anopheles gambiae
uaucacagccauuuugacgagu

SEQ ID NO: 10 - RNA, 21 nt, Anopheles gambiae
ucagucuuuuucucucuccua

SEQ ID NO: 11 - RNA, 21 nt, Anopheles gambiae
uggacggagaacugauaaggg

SEQ ID NO: 12 - RNA, 23 nt, Anopheles gambiae
gcucaucaaagcuggcugugaua

SEQ ID NO: 13 - RNA, 21 nt, Anopheles gambiae
uugugcgugugacaacggcua

SEQ ID NO: 14 - RNA, 23 nt, Anopheles gambiae
ugauuguccaaacgcaauucuug

SEQ ID NO: 15 - RNA, 24 nt, Anopheles gambiae
uguaauggcacuggaagaauucac

SEQ ID NO: 16 - RNA, 23 nt, Anopheles gambiae
ucagguaccugaaguagcgcgcg

SEQ ID NO: 17 - RNA, 23 nt, Anopheles gambiae
cagcgagguauagaguuccuacg

SEQ ID NO: 18 - RNA, 23 nt, Anopheles gambiae
uaaaugcacuaucugguacgaca

SEQ ID NO: 19 - RNA, 22 nt, Anopheles gambiae
ucggugggacuuucguccguuu

SEQ ID NO: 20 - RNA, 22 nt, Anopheles gambiae
ugacuagauccacacucauuaa

SEQ ID NO: 21 - RNA, 23 nt, Anopheles gambiae
ugucauggaauugcucucuuuau

SEQ ID NO: 22 - RNA, 28 nt, Anopheles gambiae
aaucuagccucuucuaggcuuugucugu

SEQ ID NO: 23 - RNA, 21 nt, Anopheles gambiae
uaaauaucagcugguaauucu

SEQ ID NO: 24 - RNA, 23 nt, Anopheles gambiae
auuguacuucaucaggugcucug

SEQ ID NO: 25 - RNA, 20 nt, Anopheles gambiae
ucacaaccuccuugagugag

SEQ ID NO: 26 - RNA, 22 nt, Anopheles gambiae
aaucacaggaguauacugugag

SEQ ID NO: 27 - RNA, 22 nt, Anopheles gambiae
uuuugauuguugcucagaaagc

SEQ ID NO: 28 - RNA, 25 nt, Anopheles gambiae
ugaacacaucuggugguaucucagu

SEQ ID NO: 29 - RNA, 23 nt, Anopheles gambiae
uggaagacuagugauuuuguugu

SEQ ID NO: 30 - RNA, 22 nt, Anopheles gambiae
uaaagcuagauuaccaaagcau

SEQ ID NO: 31 - RNA, 23 nt, Anopheles gambiae
uaauacugucagguaaagauguc

SEQ ID NO: 32 - RNA, 22 nt, Anopheles gambiae
uauugcacuugucccggccuau

SEQ ID NO: 33 - RNA, 22 nt, Anopheles gambiae
aauugcacuugucccggccugc

SEQ ID NO: 34 - RNA, 23 nt, Anopheles gambiae
ucuuugguuaucuagcuguauga

SEQ ID NO: 35 - RNA, 23 nt, Anopheles gambiae
acuuuggugauuuuagcuguaug

SEQ ID NO: 36 - RNA, 22 nt, Anopheles gambiae
ucuuugguauucuagcuguaga

SEQ ID NO: 37 - RNA, 22 nt, Anopheles gambiae
acguauacugaauguauccuga

SEQ ID NO: 38 - RNA, 22 nt, Ateles geoffroyi
aacccguagauccgaacuugug

SEQ ID NO: 39 - RNA, 22 nt, Ateles geoffroyi
uacaguacugugauaacugaag

SEQ ID NO: 40 - RNA, 23 nt, Ateles geoffroyi
agcagcauuguacagggcuauga

SEQ ID NO: 41 - RNA, 24 nt, Ateles geoffroyi
aaaagugcuuacagugcagguagc

SEQ ID NO: 42 - RNA, 21 nt, Ateles geoffroyi
uaaagugcugacagugcagau

SEQ ID NO: 43 - RNA, 23 nt, Ateles geoffroyi
uacccuguagauccgaauuugug

SEQ ID NO: 44 - RNA, 22 nt, Ateles geoffroyi
uuaaggcacgcggugaaugcca

SEQ ID NO: 45 - RNA, 22 nt, Ateles geoffroyi
ucccugagacccuaacuuguga

SEQ ID NO: 46 - RNA, 22 nt, Ateles geoffroyi
ucggauccgucugagcuuggcu

SEQ ID NO: 47 - RNA, 22 nt, Ateles geoffroyi
ucacagugaaccggucucuuuu

SEQ ID NO: 48 - RNA, 22 nt, Ateles geoffroyi
uugguccccuucaaccagcugu

SEQ ID NO: 49 - RNA, 23 nt, Ateles geoffroyi
uauggcuuuuuauuccuauguga

SEQ ID NO: 50 - RNA, 22 nt, Ateles geoffroyi
uagcagcacauaaugguuugug

SEQ ID NO: 51 - RNA, 22 nt, Ateles geoffroyi
uagcagcacaucaugguuuaca

SEQ ID NO: 52 - RNA, 22 nt, Ateles geoffroyi
uagcagcacguaaauauuggcg

SEQ ID NO: 53 - RNA, 20 nt, Ateles geoffroyi
acugcagugaaggcacuugu

SEQ ID NO: 54 - RNA, 24 nt, Ateles geoffroyi
caaagugcuuacagugcagguagu

SEQ ID NO: 55 - RNA, 22 nt, Ateles geoffroyi
uaaggugcaucuagugcagaua

SEQ ID NO: 56 - RNA, 22 nt, Ateles geoffroyi
uguaacagcaacuccaugugga

SEQ ID NO: 57 - RNA, 22 nt, Ateles geoffroyi
uagguaguuucauguuguuggg

SEQ ID NO: 58 - RNA, 22 nt, Ateles geoffroyi
uucaccaccuucuccacccagc

SEQ ID NO: 59 - RNA, 19 nt, Ateles geoffroyi
gguccagaggggagcuagg

SEQ ID NO: 60 - RNA, 23 nt, Ateles geoffroyi
ugugcaaaucuaugcaaaacuga

SEQ ID NO: 61 - RNA, 23 nt, Ateles geoffroyi
ugugcaaauccaugcaaaacuga

SEQ ID NO: 62 - RNA, 22 nt, Ateles geoffroyi
uaaagugcuuauagugcaggua

SEQ ID NO: 63 - RNA, 22 nt, Ateles geoffroyi
uccuucauuccaccggagucug

SEQ ID NO: 64 - RNA, 22 nt, Ateles geoffroyi
uagcuuaucagacugauguuga

SEQ ID NO: 65 - RNA, 21 nt, Ateles geoffroyi
acagcaggcacagacaggcag

SEQ ID NO: 66 - RNA, 21 nt, Ateles geoffroyi
uugugcuugaucuaaccaugu

SEQ ID NO: 67 - RNA, 22 nt, Ateles geoffroyi
aagcugccaguugaagaacugu

SEQ ID NO: 68 - RNA, 24 nt, Ateles geoffroyi
agcuacaucuggcuacugggucuc

SEQ ID NO: 69 - RNA, 21 nt, Ateles geoffroyi
aucacauugccagggauuucc

SEQ ID NO: 70 - RNA, 22 nt, Ateles geoffroyi
uucacaguggcuaaguuccgcc

SEQ ID NO: 71 - RNA, 22 nt, Ateles geoffroyi
aaggagcucacagucuauugag

SEQ ID NO: 72 - RNA, 22 nt, Ateles geoffroyi
cuagcaccaucugaaaucgguu

SEQ ID NO: 73 - RNA, 20 nt, Ateles geoffroyi
uagcaccauuugaaaucagu

SEQ ID NO: 74 - RNA, 21 nt, Ateles geoffroyi
uguaaacauccuacacucagc

SEQ ID NO: 75 - RNA, 22 nt, Ateles geoffroyi
uggcagugucuuagcugguugu

SEQ ID NO: 76 - RNA, 23 nt, Ateles geoffroyi
ucuuugguuaucuagcuguauga

SEQ ID NO: 77 - RNA, 22 nt, Ateles geoffroyi
uauugcacuugucccggccugu

SEQ ID NO: 78 - RNA, 22 nt, Ateles geoffroyi
aaagugcuguucgugcagguag

SEQ ID NO: 79 - RNA, 22 nt, Ateles geoffroyi
ugagguaguaaguuguauuguu

SEQ ID NO: 80 - RNA, 23 nt, Apis mellifera
ugagaucauugugaaagcugauu

SEQ ID NO: 81 - RNA, 22 nt, Apis mellifera
uggaauguaaagaaguauggag

SEQ ID NO: 82 - RNA, 23 nt, Apis mellifera
ugaguauuacaucagguacuggu

SEQ ID NO: 83 - RNA, 23 nt, Apis mellifera
uaaggcacgcggugaaugccaag

SEQ ID NO: 84 - RNA, 22 nt, Apis mellifera
ccccugagacccuaacuuguga

SEQ ID NO: 85 - RNA, 22 nt, Apis mellifera
uugguccccuucaaccagcugu

SEQ ID NO: 86 - RNA, 22 nt, Apis mellifera
uggacggagaacugauaagggc

SEQ ID NO: 87 - RNA, 23 nt, Apis mellifera
uaucacagccagcuuugaugagc

SEQ ID NO: 88 - RNA, 21 nt, Apis mellifera
uugugcgugugacagcggcua

SEQ ID NO: 89 - RNA, 23 nt, Apis mellifera
ugauuguccaaacgcaauucuug

SEQ ID NO: 90 - RNA, 24 nt, Apis mellifera
guaaauggcacuggaagaauucac

SEQ ID NO: 91 - RNA, 22 nt, Apis mellifera
uaggaacuucauaccgugcucu

SEQ ID NO: 92 - RNA, 23 nt, Apis mellifera
uaaaugcacuaucugguacgaca

SEQ ID NO: 93 - RNA, 22 nt, Apis mellifera
ucggugggacuuucguccguuu

SEQ ID NO: 94 - RNA, 23 nt, Apis mellifera
ugucauggaguugcucucuuugu

SEQ ID NO: 95 - RNA, 28 nt, Apis mellifera
gauuuagccucuccuaggcuuugucugu

SEQ ID NO: 96 - RNA, 23 nt, Apis mellifera
auuguacuucaucaggugcucug

SEQ ID NO: 97 - RNA, 22 nt, Apis mellifera
uuuugauuguugcucagaaagc

SEQ ID NO: 98 - RNA, 25 nt, Apis mellifera
ugaacacagcuggugguaucucagu

SEQ ID NO: 99 - RNA, 23 nt, Apis mellifera
uggaagacuagugauuuuguugu

SEQ ID NO: 100 - RNA, 23 nt, Apis mellifera
uaauacugucagguaaagauguc

SEQ ID NO: 101 - RNA, 23 nt, Apis mellifera
ucuuugguuaucuagcuguauga

SEQ ID NO: 102 - RNA, 23 nt, Apis mellifera
gcuuugguaaucuagcuuuauga

SEQ ID NO: 103 - RNA, 22 nt, Apis mellifera
acguauacugaauguauccuga

SEQ ID NO: 104 - RNA, 20 nt, Arabidopsis thaliana
ugacagaagagagugagcac

SEQ ID NO: 105 - RNA, 20 nt, Arabidopsis thaliana
ugacagaagagagugagcac

SEQ ID NO: 106 - RNA, 20 nt, Arabidopsis thaliana
ugacagaagagagugagcac

SEQ ID NO: 107 - RNA, 20 nt, Arabidopsis thaliana
ugacagaagagagugagcac

SEQ ID NO: 108 - RNA, 20 nt, Arabidopsis thaliana
ugacagaagagagugagcac

SEQ ID NO: 109 - RNA, 20 nt, Arabidopsis thaliana
ugacagaagagagugagcac

SEQ ID NO: 110 - RNA, 21 nt, Arabidopsis thaliana
cgacagaagagagugagcaca

SEQ ID NO: 111 - RNA, 21 nt, Arabidopsis thaliana
uugacagaagaaagagagcac

SEQ ID NO: 112 - RNA, 21 nt, Arabidopsis thaliana
uugacagaagauagagagcac

SEQ ID NO: 113 - RNA, 21 nt, Arabidopsis thaliana
uugacagaagauagagagcac

SEQ ID NO: 114 - RNA, 21 nt, Arabidopsis thaliana
uugacagaagauagagagcac

SEQ ID NO: 115 - RNA, 20 nt, Arabidopsis thaliana
ugacagaagauagagagcac

SEQ ID NO: 116 - RNA, 20 nt, Arabidopsis thaliana
ucccaaauguagacaaagca

SEQ ID NO: 117 - RNA, 20 nt, Arabidopsis thaliana
ccccaaauguagacaaagca

SEQ ID NO: 118 - RNA, 21 nt, Arabidopsis thaliana
uuuggauugaagggagcucua

SEQ ID NO: 119 - RNA, 21 nt, Arabidopsis thaliana
uuuggauugaagggagcucuu

SEQ ID NO: 120 - RNA, 21 nt, Arabidopsis thaliana
uuuggauugaagggagcuccu

SEQ ID NO: 121 - RNA, 21 nt, Arabidopsis thaliana
ugccuggcucccuguaugcca

SEQ ID NO: 122 - RNA, 21 nt, Arabidopsis thaliana
ugccuggcucccuguaugcca

SEQ ID NO: 123 - RNA, 21 nt, Arabidopsis thaliana
ugccuggcucccuguaugcca

SEQ ID NO: 124 - RNA, 21 nt, Arabidopsis thaliana
uugaaagugacuacaucgggg

SEQ ID NO: 125 - RNA, 21 nt, Arabidopsis thaliana
ucgauaaaccucugcauccag

SEQ ID NO: 126 - RNA, 21 nt, Arabidopsis thaliana
ucgauaaaccucugcauccag

SEQ ID NO: 127 - RNA, 24 nt, Arabidopsis thaliana
uugaagaggacuuggaacuucgau

SEQ ID NO: 128 - RNA, 21 nt, Arabidopsis thaliana
uggagaagcagggcacgugca

SEQ ID NO: 129 - RNA, 21 nt, Arabidopsis thaliana
uggagaagcagggcacgugca

SEQ ID NO: 130 - RNA, 21 nt, Arabidopsis thaliana
uggagaagcagggcacgugcg

SEQ ID NO: 131 - RNA, 21 nt, Arabidopsis thaliana
ucggaccaggcuucauccccc

SEQ ID NO: 132 - RNA, 21 nt, Arabidopsis thaliana
ucggaccaggcuucauccccc

SEQ ID NO: 133 - RNA, 21 nt, Arabidopsis thaliana
ucggaccaggcuucauucccc

SEQ ID NO: 134 - RNA, 21 nt, Arabidopsis thaliana
ucggaccaggcuucauucccc

SEQ ID NO: 135 - RNA, 21 nt, Arabidopsis thaliana
ucggaccaggcuucauucccc

SEQ ID NO: 136 - RNA, 21 nt, Arabidopsis thaliana
ucggaccaggcuucauucccc

SEQ ID NO: 137 - RNA, 21 nt, Arabidopsis thaliana
ucggaccaggcuucauucccc

SEQ ID NO: 138 - RNA, 21 nt, Arabidopsis thaliana
ucggaccaggcuucauucccc

SEQ ID NO: 139 - RNA, 21 nt, Arabidopsis thaliana
ucggaccaggcuucauucccc

SEQ ID NO: 140 - RNA, 21 nt, Arabidopsis thaliana
ugaagcugccagcaugaucua

SEQ ID NO: 141 - RNA, 21 nt, Arabidopsis thaliana
ugaagcugccagcaugaucua

SEQ ID NO: 142 - RNA, 21 nt, Arabidopsis thaliana
uuaagcugccagcaugaucuu

SEQ ID NO: 143 - RNA, 22 nt, Arabidopsis thaliana
ugaagcugccagcaugaucugg

SEQ ID NO: 144 - RNA, 21 nt, Arabidopsis thaliana
ucgcuuggugcaggucgggaa

SEQ ID NO: 145 - RNA, 21 nt, Arabidopsis thaliana
ucgcuuggugcaggucgggaa

SEQ ID NO: 146 - RNA, 21 nt, Arabidopsis thaliana
cagccaaggaugacuugccga

SEQ ID NO: 147 - RNA, 21 nt, Arabidopsis thaliana
cagccaaggaugacuugccgg

SEQ ID NO: 148 - RNA, 21 nt, Arabidopsis thaliana
cagccaaggaugacuugccgg

SEQ ID NO: 149 - RNA, 21 nt, Arabidopsis thaliana
ugagccaaggaugacuugccg

SEQ ID NO: 150 - RNA, 21 nt, Arabidopsis thaliana
ugagccaaggaugacuugccg

SEQ ID NO: 151 - RNA, 21 nt, Arabidopsis thaliana
ugagccaaggaugacuugccg

SEQ ID NO: 152 - RNA, 21 nt, Arabidopsis thaliana
ugagccaaggaugacuugccg

SEQ ID NO: 153 - RNA, 21 nt, Arabidopsis thaliana
uccggcaaguugaccuuggcu

SEQ ID NO: 154 - RNA, 21 nt, Arabidopsis thaliana
uagccaaggaugacuugccug

SEQ ID NO: 155 - RNA, 21 nt, Arabidopsis thaliana
uagccaaggaugacuugccug

SEQ ID NO: 156 - RNA, 21 nt, Arabidopsis thaliana
uagccaaggaugacuugccug

SEQ ID NO: 157 - RNA, 21 nt, Arabidopsis thaliana
uagccaaggaugacuugccug

SEQ ID NO: 158 - RNA, 21 nt, Arabidopsis thaliana
uagccaaggaugacuugccug

SEQ ID NO: 159 - RNA, 21 nt, Arabidopsis thaliana
uagccaaggaugacuugccug

SEQ ID NO: 160 - RNA, 21 nt, Arabidopsis thaliana
uagccaaggaugacuugccug

SEQ ID NO: 161 - RNA, 21 nt, Arabidopsis thaliana
ugauugagccgugucaauauc

SEQ ID NO: 162 - RNA, 21 nt, Arabidopsis thaliana
ugauugagccgcgccaauauc

SEQ ID NO: 163 - RNA, 21 nt, Arabidopsis thaliana
uugagccgugccaauaucacg

SEQ ID NO: 164 - RNA, 21 nt, Arabidopsis thaliana
uugagccgugccaauaucacg

SEQ ID NO: 165 - RNA, 21 nt, Arabidopsis thaliana
agaaucuugaugaugcugcau

SEQ ID NO: 166 - RNA, 21 nt, Arabidopsis thaliana
agaaucuugaugaugcugcau

SEQ ID NO: 167 - RNA, 20 nt, Arabidopsis thaliana
gcagcaccauuaagauucac

SEQ ID NO: 168 - RNA, 21 nt, Arabidopsis thaliana
agaaucuugaugaugcugcag

SEQ ID NO: 169 - RNA, 21 nt, Arabidopsis thaliana
agaaucuugaugaugcugcag

SEQ ID NO: 170 - RNA, 21 nt, Arabidopsis thaliana
ggaaucuugaugaugcugcau

SEQ ID NO: 171 - RNA, 22 nt, Arabidopsis thaliana
uucgcuugcagagagaaaucac

SEQ ID NO: 172 - RNA, 20 nt, Arabidopsis thaliana
uuggacugaagggagcuccc

SEQ ID NO: 173 - RNA, 20 nt, Arabidopsis thaliana
uuggacugaagggagcuccc

SEQ ID NO: 174 - RNA, 20 nt, Arabidopsis thaliana
uuggacugaagggagcuccu

SEQ ID NO: 175 - RNA, 21 nt, Arabidopsis thaliana
aagcucaggagggauagcgcc

SEQ ID NO: 176 - RNA, 21 nt, Arabidopsis thaliana
aagcucaggagggauagcgcc

SEQ ID NO: 177 - RNA, 21 nt, Arabidopsis thaliana
uucgcaggagagauagcgcca

SEQ ID NO: 178 - RNA, 21 nt, Arabidopsis thaliana
uccaaagggaucgcauugauc

SEQ ID NO: 179 - RNA, 21 nt, Arabidopsis thaliana
uccaaagggaucgcauugauc

SEQ ID NO: 180 - RNA, 20 nt, Arabidopsis thaliana
uuggcauucuguccaccucc

SEQ ID NO: 181 - RNA, 20 nt, Arabidopsis thaliana
uuggcauucuguccaccucc

SEQ ID NO: 182 - RNA, 21 nt, Arabidopsis thaliana
cugaaguguuugggggaacuc

SEQ ID NO: 183 - RNA, 21 nt, Arabidopsis thaliana
cugaaguguuuggggggacuc

SEQ ID NO: 184 - RNA, 21 nt, Arabidopsis thaliana
cugaaguguuuggggggacuc

SEQ ID NO: 185 - RNA, 21 nt, Arabidopsis thaliana
cugaaguguuugggggaacuc

SEQ ID NO: 186 - RNA, 21 nt, Arabidopsis thaliana
cugaaguguuugggggaacuc

SEQ ID NO: 187 - RNA, 21 nt, Arabidopsis thaliana
cugaaguguuuggggggacuc

SEQ ID NO: 188 - RNA, 21 nt, Arabidopsis thaliana
uuccacagcuuucuugaacug

SEQ ID NO: 189 - RNA, 21 nt, Arabidopsis thaliana
uuccacagcuuucuugaacuu

SEQ ID NO: 190 - RNA, 21 nt, Arabidopsis thaliana
ucauugagugcagcguugaug

SEQ ID NO: 191 - RNA, 21 nt, Arabidopsis thaliana
ucauugagugcaucguugaug

SEQ ID NO: 192 - RNA, 21 nt, Arabidopsis thaliana
uguguucucaggucaccccuu

SEQ ID NO: 193 - RNA, 21 nt, Arabidopsis thaliana
uguguucucaggucaccccug

SEQ ID NO: 194 - RNA, 21 nt, Arabidopsis thaliana
uguguucucaggucaccccug

SEQ ID NO: 195 - RNA, 21 nt, Arabidopsis thaliana
ugccaaaggagauuugcccug

SEQ ID NO: 196 - RNA, 21 nt, Arabidopsis thaliana
ugccaaaggagaguugcccug

SEQ ID NO: 197 - RNA, 21 nt, Arabidopsis thaliana
ugccaaaggagaguugcccug

SEQ ID NO: 198 - RNA, 21 nt, Arabidopsis thaliana
ugccaaaggagauuugccccg

SEQ ID NO: 199 - RNA, 21 nt, Arabidopsis thaliana
ugccaaaggagauuugccucg

SEQ ID NO: 200 - RNA, 21 nt, Arabidopsis thaliana
ugccaaaggagauuugcccgg

SEQ ID NO: 201 - RNA, 21 nt, Arabidopsis thaliana
uaugagaguauuauaagucac

SEQ ID NO: 202 - RNA, 21 nt, Arabidopsis thaliana
cgaaacuggugucgaccgaca

SEQ ID NO: 203 - RNA, 22 nt, Arabidopsis thaliana
uucgaggccuauuaaaccucug

SEQ ID NO: 204 - RNA, 21 nt, Arabidopsis thaliana
uuagauucacgcacaaacucg

SEQ ID NO: 205 - RNA, 24 nt, Arabidopsis thaliana
auuaacgcuggcgguugcggcagc

SEQ ID NO: 206 - RNA, 24 nt, Arabidopsis thaliana
augaguugggucuaacccauaacu

SEQ ID NO: 207 - RNA, 24 nt, Arabidopsis thaliana
augaguugggucuaacccauaacu

SEQ ID NO: 208 - RNA, 24 nt, Arabidopsis thaliana
augaguugggucuaacccauaacu

SEQ ID NO: 209 - RNA, 21 nt, Arabidopsis thaliana
uagaaugcuauuguaauccag

SEQ ID NO: 210 - RNA, 21 nt, Arabidopsis thaliana
uuuaaaucauauacuuuuggu

SEQ ID NO: 211 - RNA, 21 nt, Arabidopsis thaliana
augcacugccucuucccuggc

SEQ ID NO: 212 - RNA, 21 nt, Arabidopsis thaliana
auaguuucucuuguucugcac

SEQ ID NO: 213 - RNA, 21 nt, Arabidopsis thaliana
ucaucuucaucaucaucguca

SEQ ID NO: 214 - RNA, 21 nt, Arabidopsis thaliana
aacagagcagaaacagaacau

SEQ ID NO: 215 - RNA, 21 nt, Arabidopsis thaliana
gguucguacguacacuguuca

SEQ ID NO: 216 - RNA, 21 nt, Arabidopsis thaliana
gaagguagugaauuuguucga

SEQ ID NO: 217 - RNA, 21 nt, Arabidopsis thaliana
uaaugugaugaugaacugacc

SEQ ID NO: 218 - RNA, 21 nt, Arabidopsis thaliana
uuaugaaugcugaggauguug

SEQ ID NO: 219 - RNA, 21 nt, Arabidopsis thaliana
uaaacuaaucacggaaaugca

SEQ ID NO: 220 - RNA, 21 nt, Arabidopsis thaliana
uuuuggaaauuuguccuuacg

SEQ ID NO: 221 - RNA, 22 nt, Arabidopsis thaliana
uuggggacgagauguuuuguug

SEQ ID NO: 222 - RNA, 22 nt, Arabidopsis thaliana
uuggggacgagauguuuuguug

SEQ ID NO: 223 - RNA, 22 nt, Arabidopsis thaliana
uuggggacgacaucuuuuguug

SEQ ID NO: 224 - RNA, 21 nt, Arabidopsis thaliana
ugagccucugugguagcccuc

SEQ ID NO: 225 - RNA, 21 nt, Arabidopsis thaliana
uuuuuccuacuccgcccauac

SEQ ID NO: 226 - RNA, 21 nt, Arabidopsis thaliana
uuugcuuccagcuuuugucuc

SEQ ID NO: 227 - RNA, 21 nt, Arabidopsis thaliana
uugguuacccauauggccauc

SEQ ID NO: 228 - RNA, 21 nt, Arabidopsis thaliana
uucgaugucuagcagugccaa

SEQ ID NO: 229 - RNA, 21 nt, Arabidopsis thaliana
ucuaagucuucuauugauguu

SEQ ID NO: 230 - RNA, 21 nt, Arabidopsis thaliana
uacgcauugaguuucguugcu

SEQ ID NO: 231 - RNA, 21 nt, Arabidopsis thaliana
uggcuugguuuauguacaccg

SEQ ID NO: 232 - RNA, 21 nt, Arabidopsis thaliana
uucugcuauguugcugcucau

SEQ ID NO: 233 - RNA, 21 nt, Arabidopsis thaliana
uuucuucgugaauaucuggca

SEQ ID NO: 234 - RNA, 21 nt, Arabidopsis thaliana
uuagaguuuucuggauacuua

SEQ ID NO: 235 - RNA, 21 nt, Arabidopsis thaliana
acaaacaccuuggauguucuu

SEQ ID NO: 236 - RNA, 21 nt, Arabidopsis thaliana
aagcuuugcucguucauguuc

SEQ ID NO: 237 - RNA, 21 nt, Bombyx mori
ugagguaguagguuguauagu

SEQ ID NO: 238 - RNA, 22 nt, Bombyx mori
uggaauguaaagaaguauggag

SEQ ID NO: 239 - RNA, 21 nt, Bombyx mori
acccuguagauccgaauuugu

SEQ ID NO: 240 - RNA, 23 nt, Bombyx mori
uaaggcacgcggugaaugccaag

SEQ ID NO: 241 - RNA, 21 nt, Bombyx mori
ucagucuuuuucucucuccua

SEQ ID NO: 242 - RNA, 21 nt, Bombyx mori
aauggcacuggaagaauucac

SEQ ID NO: 243 - RNA, 21 nt, Bombyx mori
cuuggcacugggagaauucac

SEQ ID NO: 244 - RNA, 23 nt, Bombyx mori
ucagguaccugaaguagcgcgcg

SEQ ID NO: 245 - RNA, 22 nt, Bombyx mori
agcgagguauagaguuccuacg

SEQ ID NO: 246 - RNA, 23 nt, Bombyx mori
uaaaugcacuaucugguacgaca

SEQ ID NO: 247 - RNA, 19 nt, Bombyx mori
ugacuagauccacacucau

SEQ ID NO: 248 - RNA, 27 nt, Bombyx mori
accuagccucuccuuggcuuugucugu

SEQ ID NO: 249 - RNA, 21 nt, Bombyx mori
uaaauaucagcugguaauucu

SEQ ID NO: 250 - RNA, 23 nt, Bombyx mori
auuguacuucaucaggugcucug

SEQ ID NO: 251 - RNA, 20 nt, Bombyx mori
ucacaaccuccuugagugag

SEQ ID NO: 252 - RNA, 21 nt, Bombyx mori
ggcaagaagucggcauagcug

SEQ ID NO: 253 - RNA, 22 nt, Bombyx mori
uggcagugugguuagcugguug

SEQ ID NO: 254 - RNA, 23 nt, Bombyx mori
uggaagacuagugauuuuguugu

SEQ ID NO: 255 - RNA, 19 nt, Bombyx mori
ugaaagacauggguaguga

SEQ ID NO: 256 - RNA, 23 nt, Bombyx mori
uaauacugucagguaaagauguc

SEQ ID NO: 257 - RNA, 23 nt, Bombyx mori
ucuuugguuaucuagcuguauga

SEQ ID NO: 258 - RNA, 22 nt, Bos taurus
ugagguaguagguuguauaguu

SEQ ID NO: 259 - RNA, 22 nt, Bos taurus
agagguaguagguugcauaguu

SEQ ID NO: 260 - RNA, 22 nt, Bos taurus
ugagguaguagauuguauaguu

SEQ ID NO: 261 - RNA, 22 nt, Bos taurus
ugagguaguaguuuguacaguu

SEQ ID NO: 262 - RNA, 22 nt, Bos taurus
ugagguaguaguuugugcuguu

SEQ ID NO: 263 - RNA, 21 nt, Bos taurus
uacaguacugugauaacugaa

SEQ ID NO: 264 - RNA, 23 nt, Bos taurus
agcagcauuguacagggcuauga

SEQ ID NO: 265 - RNA, 22 nt, Bos taurus
aaaagugcuuacagugcaggua

SEQ ID NO: 266 - RNA, 22 nt, Bos taurus
agcagcauuguacagggcuauc

SEQ ID NO: 267 - RNA, 23 nt, Bos taurus
uacccuguagauccgaauuugug

SEQ ID NO: 268 - RNA, 23 nt, Bos taurus
uacccuguagaaccgaauuugug

SEQ ID NO: 269 - RNA, 22 nt, Bos taurus
uggagugugacaaugguguuug

SEQ ID NO: 270 - RNA, 23 nt, Bos taurus
uuaaggcacgcggugaaugccaa

SEQ ID NO: 271 - RNA, 23 nt, Bos taurus
ucccugagacccuuuaaccugug

SEQ ID NO: 272 - RNA, 22 nt, Bos taurus
ucccugagacccuaacuuguga

SEQ ID NO: 273 - RNA, 21 nt, Bos taurus
cguaccgugaguaauaaugcg

SEQ ID NO: 274 - RNA, 22 nt, Bos taurus
ucggauccgucugagcuuggcu

SEQ ID NO: 275 - RNA, 22 nt, Bos taurus
ucacagugaaccggucucuuuu

SEQ ID NO: 276 - RNA, 22 nt, Bos taurus
uaacagucuacagccauggucg

SEQ ID NO: 277 - RNA, 23 nt, Bos taurus
agcugguguugugaaucaggccg

SEQ ID NO: 278 - RNA, 23 nt, Bos taurus
ucuacagugcacgugucuccagu

SEQ ID NO: 279 - RNA, 22 nt, Bos taurus
uaccacaggguagaaccacgga

SEQ ID NO: 280 - RNA, 20 nt, Bos taurus
cauaaaguagaaagcacuac

SEQ ID NO: 281 - RNA, 22 nt, Bos taurus
aguguuuccuacuuuauggaug

SEQ ID NO: 282 - RNA, 23 nt, Bos taurus
guccaguuuucccaggaaucccu

SEQ ID NO: 283 - RNA, 22 nt, Bos taurus
ucagugcacuacagaacuuugu

SEQ ID NO: 284 - RNA, 22 nt, Bos taurus
ucagugcaucacagaacuuugu

SEQ ID NO: 285 - RNA, 23 nt, Bos taurus
ucucccaacccuuguaccagugu

SEQ ID NO: 286 - RNA, 21 nt, Bos taurus
cuagacugaagcuccuugagg

SEQ ID NO: 287 - RNA, 21 nt, Bos taurus
ucgaggagcucacagucuagu

SEQ ID NO: 288 - RNA, 22 nt, Bos taurus
uagcagcacaucaugguuuaca

SEQ ID NO: 289 - RNA, 21 nt, Bos taurus
uagcagcacguaaauauuggc

SEQ ID NO: 290 - RNA, 20 nt, Bos taurus
acugcagugaaggcacuugu

SEQ ID NO: 291 - RNA, 24 nt, Bos taurus
caaagugcuuacagugcagguagu

SEQ ID NO: 292 - RNA, 24 nt, Bos taurus
aacauucaacgcugucggugaguu

SEQ ID NO: 293 - RNA, 25 nt, Bos taurus
aacauucauugcugucgguggguuu

SEQ ID NO: 294 - RNA, 24 nt, Bos taurus
aacauucaaccugucggugaguuu

SEQ ID NO: 295 - RNA, 22 nt, Bos taurus
caaagaauucuccuuuugggcu

SEQ ID NO: 296 - RNA, 22 nt, Bos taurus
uaaggugcaucuagugcagaua

SEQ ID NO: 297 - RNA, 22 nt, Bos taurus
uaaggugcaucuagugcaguua

SEQ ID NO: 298 - RNA, 23 nt, Bos taurus
caacggaaucccaaaagcagcug

SEQ ID NO: 299 - RNA, 23 nt, Bos taurus
cugaccuaugaauugacagccag

SEQ ID NO: 300 - RNA, 22 nt, Bos taurus
aacuggccuacaaagucccagu

SEQ ID NO: 301 - RNA, 22 nt, Bos taurus
ugggucuuugcgggcgagauga

SEQ ID NO: 302 - RNA, 22 nt, Bos taurus
cccaguguucagacuaccuguu

SEQ ID NO: 303 - RNA, 22 nt, Bos taurus
acaguagucugcacauugguua

SEQ ID NO: 304 - RNA, 23 nt, Bos taurus
cccaguguuuagacuaucuguuc

SEQ ID NO: 305 - RNA, 23 nt, Bos taurus
uaacacugucugguaacgauguu

SEQ ID NO: 306 - RNA, 21 nt, Bos taurus
uaauacugccugguaaugaug

SEQ ID NO: 307 - RNA, 23 nt, Bos taurus
uaauacugccggguaaugaugga

SEQ ID NO: 308 - RNA, 22 nt, Bos taurus
uccuucauuccaccggagucug

SEQ ID NO: 309 - RNA, 23 nt, Bos taurus
uaaagugcuuauagugcagguag

SEQ ID NO: 310 - RNA, 22 nt, Bos taurus
caaagugcucacagugcaggua

SEQ ID NO: 311 - RNA, 24 nt, Bos taurus
uagcuuaucagacugauguugacu

SEQ ID NO: 312 - RNA, 22 nt, Bos taurus
aacagcagucgaugggcugucu

SEQ ID NO: 313 - RNA, 23 nt, Bos taurus
acugugcgugugacagcggcuga

SEQ ID NO: 314 - RNA, 24 nt, Bos taurus
guacagcaggcacagacaggcagu

SEQ ID NO: 315 - RNA, 22 nt, Bos taurus
augaccuaugaauugacagaca

SEQ ID NO: 316 - RNA, 21 nt, Bos taurus
uugugcuugaucuaaccaugu

SEQ ID NO: 317 - RNA, 22 nt, Bos taurus
aguucuucaguggcaagcuuua

SEQ ID NO: 318 - RNA, 22 nt, Bos taurus
agcuacauugucugcuggguuu

SEQ ID NO: 319 - RNA, 21 nt, Bos taurus
agcuacaucuggcuacugggu

SEQ ID NO: 320 - RNA, 22 nt, Bos taurus
aucacauugccagggauuucca

SEQ ID NO: 321 - RNA, 23 nt, Bos taurus
aucacauugccagggauuaccac

SEQ ID NO: 322 - RNA, 22 nt, Bos taurus
uggcucaguucagcaggaacag

SEQ ID NO: 323 - RNA, 22 nt, Bos taurus
cauugcacuugucucggucuga

SEQ ID NO: 324 - RNA, 22 nt, Bos taurus
uucaaguaauccaggauaggcu

SEQ ID NO: 325 - RNA, 22 nt, Bos taurus
uucaaguaauucaggauagguu

SEQ ID NO: 326 - RNA, 20 nt, Bos taurus
uucacaguggcuaaguuccg

SEQ ID NO: 327 - RNA, 21 nt, Bos taurus
uucacaguggcuaaguucugc

SEQ ID NO: 328 - RNA, 23 nt, Bos taurus
cuagcaccaucugaaaucgguua

SEQ ID NO: 329 - RNA, 24 nt, Bos taurus
uagcaccauuugaaaucaguguuu

SEQ ID NO: 330 - RNA, 22 nt, Bos taurus
uagcaccauuugaaaucgguua

SEQ ID NO: 331 - RNA, 24 nt, Bos taurus
uguaaacauccucgacuggaagcu

SEQ ID NO: 332 - RNA, 22 nt, Bos taurus
uguaaacauccuacacucagcu

SEQ ID NO: 333 - RNA, 23 nt, Bos taurus
uguaaacauccuacacucucagc

SEQ ID NO: 334 - RNA, 24 nt, Bos taurus
uguaaacauccccgacuggaagcu

SEQ ID NO: 335 - RNA, 24 nt, Bos taurus
uguaaacauccuugacuggaagcu

SEQ ID NO: 336 - RNA, 21 nt, Bos taurus
aggcaagaugcuggcauagcu

SEQ ID NO: 337 - RNA, 22 nt, Bos taurus
aaaagcuggguugagagggcga

SEQ ID NO: 338 - RNA, 25 nt, Bos taurus
ucucacacagaaaucgcacccaucu

SEQ ID NO: 339 - RNA, 21 nt, Bos taurus
gcugacuccuaguccagugcu

SEQ ID NO: 340 - RNA, 22 nt, Bos taurus
aggcaguguaauuagcugauug

SEQ ID NO: 341 - RNA, 22 nt, Bos taurus
aggcaguguaguuagcugauug

SEQ ID NO: 342 - RNA, 22 nt, Bos taurus
uuaucagaaucuccagggguac

SEQ ID NO: 343 - RNA, 21 nt, Bos taurus
auugcacgguauccaucugcg

SEQ ID NO: 344 - RNA, 21 nt, Bos taurus
aauaauacaugguugaucuuu

SEQ ID NO: 345 - RNA, 20 nt, Bos taurus
aucgaccguguuauauucgc

SEQ ID NO: 346 - RNA, 21 nt, Bos taurus
uauguaaugugguccacgucu

SEQ ID NO: 347 - RNA, 22 nt, Bos taurus
ugguugaccauagaacaugcgc

SEQ ID NO: 348 - RNA, 24 nt, Bos taurus
aagcucggucugaggccccucagu

SEQ ID NO: 349 - RNA, 22 nt, Bos taurus
aucgggaaugucguguccgccc

SEQ ID NO: 350 - RNA, 22 nt, Bos taurus
augacacgaucacucccguuga

SEQ ID NO: 351 - RNA, 22 nt, Bos taurus
uuuugcgauguguuccuaauau

SEQ ID NO: 352 - RNA, 21 nt, Bos taurus
uaugugccuuuggacuacauc

SEQ ID NO: 353 - RNA, 22 nt, Bos taurus
gcaguccaugggcauauacacu

SEQ ID NO: 354 - RNA, 22 nt, Bos taurus
ucaggcucaguccccucccgau

SEQ ID NO: 355 - RNA, 21 nt, Bos taurus
aaucauacagggacauccagu

SEQ ID NO: 356 - RNA, 22 nt, Bos taurus
aaucguacagggucauccacuu

SEQ ID NO: 357 - RNA, 21 nt, Bos taurus
uuaagacuugcagugauguuu

SEQ ID NO: 358 - RNA, 22 nt, Bos taurus
caugccuugaguguaggaccgu

SEQ ID NO: 359 - RNA, 21 nt, Bos taurus
ucaguaaauguuuauuggaug

SEQ ID NO: 360 - RNA, 22 nt, Bos taurus
aucaacaaacauuuauugugug

SEQ ID NO: 361 - RNA, 24 nt, Bos taurus
uggaagacuagugauuuuguuguu

SEQ ID NO: 362 - RNA, 22 nt, Bos taurus
uauugcacuugucccggccugu

SEQ ID NO: 363 - RNA, 22 nt, Bos taurus
caaagugcuguucgugcaggua

SEQ ID NO: 364 - RNA, 22 nt, Bos taurus
ugagguaguaaguuguauuguu

SEQ ID NO: 365 - RNA, 21 nt, Bos taurus
aacccguagauccgaucuugu

SEQ ID NO: 366 - RNA, 22 nt, Caenorhabditis briggsae
ugagguaguagguuguauaguu

SEQ ID NO: 367 - RNA, 21 nt, Caenorhabditis briggsae
ucccugagaccucaaguguga

SEQ ID NO: 368 - RNA, 21 nt, Caenorhabditis briggsae
uuuuguaugagacgcauuccg

SEQ ID NO: 369 - RNA, 21 nt, Caenorhabditis briggsae
uggaauguaaagaaguaugua

SEQ ID NO: 370 - RNA, 21 nt, Caenorhabditis briggsae
uaaggcacgcggugaaugcca

SEQ ID NO: 371 - RNA, 23 nt, Caenorhabditis briggsae
aauggcacugcaugaauucacgg

SEQ ID NO: 372 - RNA, 23 nt, Caenorhabditis briggsae
guauuaguugugcgaccaggaaa

SEQ ID NO: 373 - RNA, 24 nt, Caenorhabditis briggsae
uaagcucgugaacaacaggcagga

SEQ ID NO: 374 - RNA, 23 nt, Caenorhabditis briggsae
uaaaugcaucuuaacugcgguga

SEQ ID NO: 375 - RNA, 23 nt, Caenorhabditis briggsae
uugagcaaugcgcaugugcggga

SEQ ID NO: 376 - RNA, 21 nt, Caenorhabditis briggsae
uuauugcucgagaauacccuu

SEQ ID NO: 377 - RNA, 23 nt, Caenorhabditis briggsae
uaauacugucagguaaugacgcu

SEQ ID NO: 378 - RNA, 23 nt, Caenorhabditis briggsae
uuuguacuacaauuagguacugg

SEQ ID NO: 379 - RNA, 21 nt, Caenorhabditis briggsae
uuguacugcacaaaaguacug

SEQ ID NO: 380 - RNA, 22 nt, Caenorhabditis briggsae
uacuggccuccaaauuuucgcu

SEQ ID NO: 381 - RNA, 21 nt, Caenorhabditis briggsae
ugagguaggugugagaaauga

SEQ ID NO: 382 - RNA, 24 nt, Caenorhabditis briggsae
ucuuugguuguacaaagugguaug

SEQ ID NO: 383 - RNA, 22 nt, Caenorhabditis briggsae
auugguccccuccaaguagcuc

SEQ ID NO: 384 - RNA, 22 nt, Caenorhabditis briggsae
uuacauguauuggguaggagcu

SEQ ID NO: 385 - RNA, 23 nt, Caenorhabditis briggsae
uacacgugcucggauaacgcuca

SEQ ID NO: 386 - RNA, 22 nt, Caenorhabditis briggsae
ucacaggauuuuugaguguugc

SEQ ID NO: 387 - RNA, 22 nt, Caenorhabditis briggsae
ucacagucaacuguuggcacgg

SEQ ID NO: 388 - RNA, 24 nt, Caenorhabditis briggsae
uuaaguaguggugccgcucuuauu

SEQ ID NO: 389 - RNA, 23 nt, Caenorhabditis briggsae
uaaguaguagugccgcagguaac

SEQ ID NO: 390 - RNA, 21 nt, Caenorhabditis briggsae
cacaccucacuaacacuaacu

SEQ ID NO: 391 - RNA, 23 nt, Caenorhabditis briggsae
ugcaaaucuuuugcaacuguaua

SEQ ID NO: 392 - RNA, 21 nt, Caenorhabditis briggsae
aaaucucauccuaaucugguu

SEQ ID NO: 393 - RNA, 25 nt, Caenorhabditis briggsae
ggcaagaauuagaagcaguuuuggu

SEQ ID NO: 394 - RNA, 22 nt, Caenorhabditis briggsae
aggcagugugguuagcugguug

SEQ ID NO: 395 - RNA, 22 nt, Caenorhabditis briggsae
ucaccgggugaaaacuugcaag

SEQ ID NO: 396 - RNA, 21 nt, Caenorhabditis briggsae
caaguaucauguguugguauc

SEQ ID NO: 397 - RNA, 21 nt, Caenorhabditis briggsae
accuuguuuguugcugcuccu

SEQ ID NO: 398 - RNA, 21 nt, Caenorhabditis briggsae
uuuguuuuagccugagcuaug

SEQ ID NO: 399 - RNA, 21 nt, Caenorhabditis briggsae
augagcaacgcgaacaaaucc

SEQ ID NO: 400 - RNA, 21 nt, Caenorhabditis briggsae
aaaaugccagucauugacgga

SEQ ID NO: 401 - RNA, 22 nt, Caenorhabditis briggsae
caauugguauccuuagucgugg

SEQ ID NO: 402 - RNA, 22 nt, Caenorhabditis briggsae
ucaccgggugaaaauucgcaau

SEQ ID NO: 403 - RNA, 21 nt, Caenorhabditis briggsae
ugaccguaaucccguucacaa

SEQ ID NO: 404 - RNA, 22 nt, Caenorhabditis briggsae
ucaccgggagacaaccugguau

SEQ ID NO: 405 - RNA, 22 nt, Caenorhabditis briggsae
ucaccgggugaaaaacgguuag

SEQ ID NO: 406 - RNA, 22 nt, Caenorhabditis briggsae
ucaccgggugucaaucagcuag

SEQ ID NO: 407 - RNA, 21 nt, Caenorhabditis briggsae
ucaccgggugaaaaacuccca

SEQ ID NO: 408 - RNA, 20 nt, Caenorhabditis briggsae
caccggguuaacaucuacag

SEQ ID NO: 409 - RNA, 23 nt, Caenorhabditis briggsae
uaucacaguuuacuugcugucgc

SEQ ID NO: 410 - RNA, 21 nt, Caenorhabditis briggsae
ugacuagagacacauucagcu

SEQ ID NO: 411 - RNA, 21 nt, Caenorhabditis briggsae
ugacuagagacacauucagcu

SEQ ID NO: 412 - RNA, 22 nt, Caenorhabditis briggsae
ugucauggagucgcucucuuca

SEQ ID NO: 413 - RNA, 22 nt, Caenorhabditis briggsae
ugucauggaggcgcucucuuca

SEQ ID NO: 414 - RNA, 23 nt, Caenorhabditis briggsae
ugagguaggcucaguagaugcga

SEQ ID NO: 415 - RNA, 22 nt, Caenorhabditis briggsae
aagcaccacgagaagcugcaga

SEQ ID NO: 416 - RNA, 24 nt, Caenorhabditis briggsae
ugauaugucugauauucuuggguu

SEQ ID NO: 417 - RNA, 23 nt, Caenorhabditis briggsae
uacccguagcuccuugccauguu

SEQ ID NO: 418 - RNA, 24 nt, Caenorhabditis briggsae
cacccguacauauguuuccgugcu

SEQ ID NO: 419 - RNA, 23 nt, Caenorhabditis briggsae
uacccguauauuuuucugccgag

SEQ ID NO: 420 - RNA, 24 nt, Caenorhabditis briggsae
uacccuguagaucgagcugugugu

SEQ ID NO: 421 - RNA, 22 nt, Caenorhabditis briggsae
ugagaucguucaguacggcaau

SEQ ID NO: 422 - RNA, 23 nt, Caenorhabditis briggsae
uauuaugcacauuuucuagucca

SEQ ID NO: 423 - RNA, 23 nt, Caenorhabditis briggsae
ugacuagaaccuugacucugcuc

SEQ ID NO: 424 - RNA, 22 nt, Caenorhabditis briggsae
ugauauguaaucuagcuuacag

SEQ ID NO: 425 - RNA, 23 nt, Caenorhabditis briggsae
caugacacugaagcguguacgga

SEQ ID NO: 426 - RNA, 24 nt, Caenorhabditis briggsae
ucacaaccuccuagaaagaguaga

SEQ ID NO: 427 - RNA, 23 nt, Caenorhabditis briggsae
uaauacgugauugguguucccag

SEQ ID NO: 428 - RNA, 19 nt, Caenorhabditis briggsae
ugaaagacauggguaguga

SEQ ID NO: 429 - RNA, 19 nt, Caenorhabditis briggsae
aggcagauguuggcauagc

SEQ ID NO: 430 - RNA, 23 nt, Caenorhabditis briggsae
uggcaagauguuggcaguucagu

SEQ ID NO: 431 - RNA, 22 nt, Caenorhabditis briggsae
uggcaagaaauggcagucuaga

SEQ ID NO: 432 - RNA, 22 nt, Caenorhabditis briggsae
uuaaagcuaccaaccgccuuca

SEQ ID NO: 433 - RNA, 22 nt, Caenorhabditis briggsae
uucaucaggccauagcugucca

SEQ ID NO: 434 - RNA, 22 nt, Caenorhabditis briggsae
auaaagcuagguuaccaaagcu

SEQ ID NO: 435 - RNA, 23 nt, Caenorhabditis briggsae
ugagaucauuaguugaaagccga

SEQ ID NO: 436 - RNA, 22 nt, Caenorhabditis briggsae
ugagaucaucgugaaagcuagu

SEQ ID NO: 437 - RNA, 22 nt, Caenorhabditis briggsae
ugagaucaucgugaaagccagu

SEQ ID NO: 438 - RNA, 22 nt, Caenorhabditis briggsae
uagcaccauauaaauucagugu

SEQ ID NO: 439 - RNA, 22 nt, Caenorhabditis briggsae
ugagguaguuugcaaugcuguc

SEQ ID NO: 440 - RNA, 24 nt, Caenorhabditis briggsae
uacaaaguauuugaaaaggcgugc

SEQ ID NO: 441 - RNA, 23 nt, Caenorhabditis briggsae
uaagugaaugcuuugccacaguc

SEQ ID NO: 442 - RNA, 20 nt, Caenorhabditis briggsae
gugagcaaaguuucaggugu

SEQ ID NO: 443 - RNA, 22 nt, Caenorhabditis briggsae
ugauauguuguuugaaugcccc

SEQ ID NO: 444 - RNA, 22 nt, Caenorhabditis elegans
ugagguaguagguuguauaguu

SEQ ID NO: 445 - RNA, 21 nt, Caenorhabditis elegans
ucccugagaccucaaguguga

SEQ ID NO: 446 - RNA, 21 nt, Caenorhabditis elegans
uuuuguaugagacgcauuucg

SEQ ID NO: 447 - RNA, 21 nt, Caenorhabditis elegans
uggaauguaaagaaguaugua

SEQ ID NO: 448 - RNA, 21 nt, Caenorhabditis elegans
uaaggcacgcggugaaugcca

SEQ ID NO: 449 - RNA, 23 nt, Caenorhabditis elegans
uaucacagccagcuuugaugugc

SEQ ID NO: 450 - RNA, 22 nt, Caenorhabditis elegans
agcuuucgacaugauucugaac

SEQ ID NO: 451 - RNA, 23 nt, Caenorhabditis elegans
aauggcacugcaugaauucacgg

SEQ ID NO: 452 - RNA, 27 nt, Caenorhabditis elegans
aaugacacugguuaucuuuuccaucgu

SEQ ID NO: 453 - RNA, 23 nt, Caenorhabditis elegans
guauuaguugugcgaccaggaga

SEQ ID NO: 454 - RNA, 24 nt, Caenorhabditis elegans
uaagcucgugaucaacaggcagaa

SEQ ID NO: 455 - RNA, 23 nt, Caenorhabditis elegans
uaaaugcaucuuaacugcgguga

SEQ ID NO: 456 - RNA, 23 nt, Caenorhabditis elegans
uugagcaaugcgcaugugcggga

SEQ ID NO: 457 - RNA, 21 nt, Caenorhabditis elegans
uuauugcucgagaauacccuu

SEQ ID NO: 458 - RNA, 22 nt, Caenorhabditis elegans
uauugcacucuccccggccuga

SEQ ID NO: 459 - RNA, 23 nt, Caenorhabditis elegans
uaauacugucagguaaugacgcu

SEQ ID NO: 460 - RNA, 24 nt, Caenorhabditis elegans
ucccugagaauucucgaacagcuu

SEQ ID NO: 461 - RNA, 23 nt, Caenorhabditis elegans
uuuguacuccgaugccauucaga

SEQ ID NO: 462 - RNA, 23 nt, Caenorhabditis elegans
uuuguacuacacauagguacugg

SEQ ID NO: 463 - RNA, 21 nt, Caenorhabditis elegans
uuguacuacacaaaaguacug

SEQ ID NO: 464 - RNA, 22 nt, Caenorhabditis elegans
uacuggcccccaaaucuucgcu

SEQ ID NO: 465 - RNA, 21 nt, Caenorhabditis elegans
ugagguaggugcgagaaauga

SEQ ID NO: 466 - RNA, 21 nt, Caenorhabditis elegans
uugcguaggccuuugcuucga

SEQ ID NO: 467 - RNA, 23 nt, Caenorhabditis elegans
cgguacgaucgcggcgggauauc

SEQ ID NO: 468 - RNA, 24 nt, Caenorhabditis elegans
ucuuugguuguacaaagugguaug

SEQ ID NO: 469 - RNA, 22 nt, Caenorhabditis elegans
auugguccccuccaaguagcuc

SEQ ID NO: 470 - RNA, 22 nt, Caenorhabditis elegans
uuacauguuucggguaggagcu

SEQ ID NO: 471 - RNA, 23 nt, Caenorhabditis elegans
ugacuagagccuauucucuucuu

SEQ ID NO: 472 - RNA, 23 nt, Caenorhabditis elegans
uacacgugcacggauaacgcuca

SEQ ID NO: 473 - RNA, 22 nt, Caenorhabditis elegans
ucacaggacuuuugagcguugc

SEQ ID NO: 474 - RNA, 22 nt, Caenorhabditis elegans
ucacagucaacuguuggcaugg

SEQ ID NO: 475 - RNA, 24 nt, Caenorhabditis elegans
uuaaguaguggugccgcucuuauu

SEQ ID NO: 476 - RNA, 23 nt, Caenorhabditis elegans
uaaguaguagugccgcagguaac

SEQ ID NO: 477 - RNA, 21 nt, Caenorhabditis elegans
cacaccucacuaacacugacc

SEQ ID NO: 478 - RNA, 23 nt, Caenorhabditis elegans
ugcaaaucuuucgcgacuguagg

SEQ ID NO: 479 - RNA, 21 nt, Caenorhabditis elegans
uggaaugcauagaagacugua

SEQ ID NO: 480 - RNA, 22 nt, Caenorhabditis elegans
gaguaucaggaguacccaguga

SEQ ID NO: 481 - RNA, 21 nt, Caenorhabditis elegans
gguuuugagaggaauccuuuu

SEQ ID NO: 482 - RNA, 21 nt, Caenorhabditis elegans
aaaucucauccuaaucuggua

SEQ ID NO: 483 - RNA, 20 nt, Caenorhabditis elegans
gugaugucgaacucuuguag

SEQ ID NO: 484 - RNA, 19 nt, Caenorhabditis elegans
uagcuuuuuaguuuucacg

SEQ ID NO: 485 - RNA, 20 nt, Caenorhabditis elegans
guuucucgauguuuucugau

SEQ ID NO: 486 - RNA, 20 nt, Caenorhabditis elegans
ggcgggugguuguuguuaug

SEQ ID NO: 487 - RNA, 20 nt, Caenorhabditis elegans
ugagggaggaagggugguau

SEQ ID NO: 488 - RNA, 20 nt, Caenorhabditis elegans
aggcaagacuuuggcaaagc

SEQ ID NO: 489 - RNA, 20 nt, Caenorhabditis elegans
cccgugaagugucugcugca

SEQ ID NO: 490 - RNA, 24 nt, Caenorhabditis elegans
ggcaagaauuagaagcaguuuggu

SEQ ID NO: 491 - RNA, 20 nt, Caenorhabditis elegans
ggcaagacucuggcaaaacu

SEQ ID NO: 492 - RNA, 20 nt, Caenorhabditis elegans
ggcaugauguagcaguggag

SEQ ID NO: 493 - RNA, 20 nt, Caenorhabditis elegans
ucgccgggugggaaagcauu

SEQ ID NO: 494 - RNA, 18 nt, Caenorhabditis elegans
uguaggcauggguguuug

SEQ ID NO: 495 - RNA, 20 nt, Caenorhabditis elegans
ugcccguacugugucggcug

SEQ ID NO: 496 - RNA, 22 nt, Caenorhabditis elegans
aggcagugugguuagcugguug

SEQ ID NO: 497 - RNA, 22 nt, Caenorhabditis elegans
ucaccggguggaaacuagcagu

SEQ ID NO: 498 - RNA, 21 nt, Caenorhabditis elegans
caauugccauguguugguauu

SEQ ID NO: 499 - RNA, 21 nt, Caenorhabditis elegans
accuuguuuguugcugcuccu

SEQ ID NO: 500 - RNA, 21 nt, Caenorhabditis elegans
uuuguuuuagccugagcuaug

SEQ ID NO: 501 - RNA, 21 nt, Caenorhabditis elegans
uugagcaacgcgaacaaauca

SEQ ID NO: 502 - RNA, 21 nt, Caenorhabditis elegans
uaaaugccagucguugcagga

SEQ ID NO: 503 - RNA, 21 nt, Caenorhabditis elegans
caauugguaucccugucaagg

SEQ ID NO: 504 - RNA, 21 nt, Caenorhabditis elegans
ucacuggucuuucucugacga

SEQ ID NO: 505 - RNA, 22 nt, Caenorhabditis elegans
ucaccgggugaaaauucgcaug

SEQ ID NO: 506 - RNA, 21 nt, Caenorhabditis elegans
ugaccguaaucccguucacaa

SEQ ID NO: 507 - RNA, 22 nt, Caenorhabditis elegans
ucaccgggugaacacuugcagu

SEQ ID NO: 508 - RNA, 22 nt, Caenorhabditis elegans
ucaccgggagaaaaacuggagu

SEQ ID NO: 509 - RNA, 22 nt, Caenorhabditis elegans
ucaccggguguaaaucagcuug

SEQ ID NO: 510 - RNA, 22 nt, Caenorhabditis elegans
uaucaucgaucacgugugauga

SEQ ID NO: 511 - RNA, 22 nt, Caenorhabditis elegans
ucaccggguguacaucagcuaa

SEQ ID NO: 512 - RNA, 22 nt, Caenorhabditis elegans
ucaccgggugaaaaaucaccua

SEQ ID NO: 513 - RNA, 20 nt, Caenorhabditis elegans
caccggguuaacaucuacag

SEQ ID NO: 514 - RNA, 23 nt, Caenorhabditis elegans
uaucacaguuuacuugcugucgc

SEQ ID NO: 515 - RNA, 21 nt, Caenorhabditis elegans
ugacuagagacacauucagcu

SEQ ID NO: 516 - RNA, 21 nt, Caenorhabditis elegans
ugacuagagacacauucagcu

SEQ ID NO: 517 - RNA, 22 nt, Caenorhabditis elegans
ugucauggagucgcucucuuca

SEQ ID NO: 518 - RNA, 22 nt, Caenorhabditis elegans
ugucauggaggcgcucucuuca

SEQ ID NO: 519 - RNA, 23 nt, Caenorhabditis elegans
ugagguaggcucaguagaugcga

SEQ ID NO: 520 - RNA, 22 nt, Caenorhabditis elegans
aagcaccacgagaagcugcaga

SEQ ID NO: 521 - RNA, 24 nt, Caenorhabditis elegans
ugauaugucugguauucuuggguu

SEQ ID NO: 522 - RNA, 23 nt, Caenorhabditis elegans
uacccguagcuccuauccauguu

SEQ ID NO: 523 - RNA, 24 nt, Caenorhabditis elegans
cacccguacauauguuuccgugcu

SEQ ID NO: 524 - RNA, 24 nt, Caenorhabditis elegans
cacccguacauuuguuuccgugcu

SEQ ID NO: 525 - RNA, 24 nt, Caenorhabditis elegans
uacccguaaucuucauaauccgag

SEQ ID NO: 526 - RNA, 23 nt, Caenorhabditis elegans
uacccguauaaguuucugcugag

SEQ ID NO: 527 - RNA, 22 nt, Caenorhabditis elegans
uacccguaauguuuccgcugag

SEQ ID NO: 528 - RNA, 23 nt, Caenorhabditis elegans
uggcggauccauuuuggguugua

SEQ ID NO: 529 - RNA, 24 nt, Caenorhabditis elegans
uacccuguagaucgagcugugugu

SEQ ID NO: 530 - RNA, 22 nt, Caenorhabditis elegans
ugagaucguucaguacggcaau

SEQ ID NO: 531 - RNA, 23 nt, Caenorhabditis elegans
ucgaaucguuuaucaggaugaug

SEQ ID NO: 532 - RNA, 23 nt, Caenorhabditis elegans
uauuaugcacauuuucuaguuca

SEQ ID NO: 533 - RNA, 23 nt, Caenorhabditis elegans
ugacuagaaccguuacucaucuc

SEQ ID NO: 534 - RNA, 22 nt, Caenorhabditis elegans
ugauauguaaucuagcuuacag

SEQ ID NO: 535 - RNA, 24 nt, Caenorhabditis elegans
uaugacacugaagcgaguuggaaa

SEQ ID NO: 536 - RNA, 23 nt, Caenorhabditis elegans
uaugacacugaagcguuaccgaa

SEQ ID NO: 537 - RNA, 23 nt, Caenorhabditis elegans
uaugacacugaagcguaaccgaa

SEQ ID NO: 538 - RNA, 23 nt, Caenorhabditis elegans
caugacacugauuagggauguga

SEQ ID NO: 539 - RNA, 24 nt, Caenorhabditis elegans
ucacaaccuccuagaaagaguaga

SEQ ID NO: 540 - RNA, 23 nt, Caenorhabditis elegans
uaauacgucguugguguuuccau

SEQ ID NO: 541 - RNA, 19 nt, Caenorhabditis elegans
ugaaagacauggguaguga

SEQ ID NO: 542 - RNA, 20 nt, Caenorhabditis elegans
aggcaagauguuggcauagc

SEQ ID NO: 543 - RNA, 23 nt, Caenorhabditis elegans
uggcaagauguaggcaguucagu

SEQ ID NO: 544 - RNA, 22 nt, Caenorhabditis elegans
uggcaagaaauggcagucuaca

SEQ ID NO: 545 - RNA, 22 nt, Caenorhabditis elegans
uuaaagcuaccaaccggcuuca

SEQ ID NO: 546 - RNA, 22 nt, Caenorhabditis elegans
uucguuguugaugaagccuuga

SEQ ID NO: 547 - RNA, 22 nt, Caenorhabditis elegans
uucaucaggccauagcugucca

SEQ ID NO: 548 - RNA, 21 nt, Caenorhabditis elegans
uggaggccugguuguuugugc

SEQ ID NO: 549 - RNA, 22 nt, Caenorhabditis elegans
auaaagcuagguuaccaaagcu

SEQ ID NO: 550 - RNA, 23 nt, Caenorhabditis elegans
ugagaucauuaguugaaagccga

SEQ ID NO: 551 - RNA, 22 nt, Caenorhabditis elegans
ugagaucaucgugaaagcuagu

SEQ ID NO: 552 - RNA, 22 nt, Caenorhabditis elegans
ugagaucaucgugaaagccagu

SEQ ID NO: 553 - RNA, 22 nt, Caenorhabditis elegans
uagcaccauauaaauucaguaa

SEQ ID NO: 554 - RNA, 22 nt, Caenorhabditis elegans
ugagguaguauguaauauugua

SEQ ID NO: 555 - RNA, 24 nt, Caenorhabditis elegans
uacaaaguauuugaaaagucgugc

SEQ ID NO: 556 - RNA, 23 nt, Caenorhabditis elegans
uaagugaaugcuuugccacaguc

SEQ ID NO: 557 - RNA, 20 nt, Caenorhabditis elegans
gugagcaaaguuucaggugu

SEQ ID NO: 558 - RNA, 22 nt, Caenorhabditis elegans
ugauauguuguuugaaugcccc

SEQ ID NO: 559 - RNA, 22 nt, Canis familiaris
uaaugccccuaaaaauccuuau

SEQ ID NO: 560 - RNA, 22 nt, Canis familiaris
uaauacugucugguaaugccgu

SEQ ID NO: 561 - RNA, 22 nt, Canis familiaris
uugcauauguaggaugucccau

SEQ ID NO: 562 - RNA, 22 nt, Canis familiaris
uggcaguguauuguuagcuggu

SEQ ID NO: 563 - RNA, 22 nt, Canis familiaris
uuuuugcgauguguuccuaaua

SEQ ID NO: 564 - RNA, 23 nt, Drosophila melanogaster
ugagaucauuuugaaagcugauu

SEQ ID NO: 565 - RNA, 21 nt, Drosophila melanogaster
ugagguaguagguuguauagu

SEQ ID NO: 566 - RNA, 22 nt, Drosophila melanogaster
uggaauguaaagaaguauggag

SEQ ID NO: 567 - RNA, 21 nt, Drosophila melanogaster
acccuguagauccgaauuugu

SEQ ID NO: 568 - RNA, 22 nt, Drosophila melanogaster
aacccguaaauccgaacuugug

SEQ ID NO: 569 - RNA, 21 nt, Drosophila melanogaster
caucacagucugaguucuugc

SEQ ID NO: 570 - RNA, 23 nt, Drosophila melanogaster
ugaguauuacaucagguacuggu

SEQ ID NO: 571 - RNA, 23 nt, Drosophila melanogaster
uaaggcacgcggugaaugccaag

SEQ ID NO: 572 - RNA, 22 nt, Drosophila melanogaster
ucccugagacccuaacuuguga

SEQ ID NO: 573 - RNA, 22 nt, Drosophila melanogaster
uugguccccuucaaccagcugu

SEQ ID NO: 574 - RNA, 22 nt, Drosophila melanogaster
uaucacagccauuuugaugagu

SEQ ID NO: 575 - RNA, 22 nt, Drosophila melanogaster
uaucacagccauuuugacgagu

SEQ ID NO: 576 - RNA, 21 nt, Drosophila melanogaster
ucagucuuuuucucucuccua

SEQ ID NO: 577 - RNA, 22 nt, Drosophila melanogaster
uggacggagaacugauaagggc

SEQ ID NO: 578 - RNA, 21 nt, Drosophila melanogaster
ccuuaucauucucucgccccg

SEQ ID NO: 579 - RNA, 21 nt, Drosophila melanogaster
uugugcgugugacagcggcua

SEQ ID NO: 580 - RNA, 23 nt, Drosophila melanogaster
ugauuguccaaacgcaauucuug

SEQ ID NO: 581 - RNA, 24 nt, Drosophila melanogaster
guuaauggcacuggaagaauucac

SEQ ID NO: 582 - RNA, 21 nt, Drosophila melanogaster
cuuggcacugggagaauucac

SEQ ID NO: 583 - RNA, 26 nt, Drosophila melanogaster
uuuugugaccgacacuaacggguaau

SEQ ID NO: 584 - RNA, 23 nt, Drosophila melanogaster
ucagguaccugaaguagcgcgcg

SEQ ID NO: 585 - RNA, 23 nt, Drosophila melanogaster
cagcgagguauagaguuccuacg

SEQ ID NO: 586 - RNA, 22 nt, Drosophila melanogaster
uaggaacuucauaccgugcucu

SEQ ID NO: 587 - RNA, 22 nt, Drosophila melanogaster
uaggaacuuaauaccgugcucu

SEQ ID NO: 588 - RNA, 23 nt, Drosophila melanogaster
uaaaugcacuaucugguacgaca

SEQ ID NO: 589 - RNA, 22 nt, Drosophila melanogaster
ucggugggacuuucguccguuu

SEQ ID NO: 590 - RNA, 22 nt, Drosophila melanogaster
ugacuagauccacacucauuaa

SEQ ID NO: 591 - RNA, 27 nt, Drosophila melanogaster
uguauuuacguugcauaugaaaugaua

SEQ ID NO: 592 - RNA, 23 nt, Drosophila melanogaster
ugucauggaauugcucucuuugu

SEQ ID NO: 593 - RNA, 22 nt, Drosophila melanogaster
aagagagcuguccgucgacagu

SEQ ID NO: 594 - RNA, 22 nt, Drosophila melanogaster
aagagagcuauccgucgacagu

SEQ ID NO: 595 - RNA, 28 nt, Drosophila melanogaster
aaucuagccucuacuaggcuuugucugu

SEQ ID NO: 596 - RNA, 21 nt, Drosophila melanogaster
uaaauaucagcugguaauucu

SEQ ID NO: 597 - RNA, 29 nt, Drosophila melanogaster
ugaagucagcaacuugauuccagcaauug

SEQ ID NO: 598 - RNA, 22 nt, Drosophila melanogaster
uagcaccauucgaaaucagugc

SEQ ID NO: 599 - RNA, 23 nt, Drosophila melanogaster
ugacuagaccgaacacucgugcu

SEQ ID NO: 600 - RNA, 21 nt, Drosophila melanogaster
uguguugaaaaucguuugcac

SEQ ID NO: 601 - RNA, 23 nt, Drosophila melanogaster
uuucaugucgauuucauuucaug

SEQ ID NO: 602 - RNA, 26 nt, Drosophila melanogaster
uaaauauuuaaguggagccugcgacu

SEQ ID NO: 603 - RNA, 23 nt, Drosophila melanogaster
uaucacagccagcuuugaugagc

SEQ ID NO: 604 - RNA, 23 nt, Drosophila melanogaster
uaucacagccagcuuugaggagc

SEQ ID NO: 605 - RNA, 23 nt, Drosophila melanogaster
uaucacagccagcuuugaugggc

SEQ ID NO: 606 - RNA, 22 nt, Drosophila melanogaster
ucacugggcaaagugugucuca

SEQ ID NO: 607 - RNA, 23 nt, Drosophila melanogaster
uuuagguuucacaggaaacuggu

SEQ ID NO: 608 - RNA, 23 nt, Drosophila melanogaster
uaaucucaauuuguaaaugugag

SEQ ID NO: 609 - RNA, 23 nt, Drosophila melanogaster
auuguacuucaucaggugcucug

SEQ ID NO: 610 - RNA, 22 nt, Drosophila melanogaster
ucagguacuuagugacucucaa

SEQ ID NO: 611 - RNA, 22 nt, Drosophila melanogaster
gggggucacucugugccugugc

SEQ ID NO: 612 - RNA, 20 nt, Drosophila melanogaster
ucacaaccuccuugagugag

SEQ ID NO: 613 - RNA, 22 nt, Drosophila melanogaster
aaucacaggauuauacugugag

SEQ ID NO: 614 - RNA, 22 nt, Drosophila melanogaster
gcacuggguaaaguuuguccua

SEQ ID NO: 615 - RNA, 22 nt, Drosophila melanogaster
uauugcacacuucccggccuuu

SEQ ID NO: 616 - RNA, 22 nt, Drosophila melanogaster
uauugcacauucaccggccuga

SEQ ID NO: 617 - RNA, 22 nt, Drosophila melanogaster
uauugcacuugagacggccuga

SEQ ID NO: 618 - RNA, 22 nt, Drosophila melanogaster
uauugcacuuuucacagcccga

SEQ ID NO: 619 - RNA, 21 nt, Drosophila melanogaster
uauucgagccaauaaguucgg

SEQ ID NO: 620 - RNA, 22 nt, Drosophila melanogaster
uuuugauuguugcucagaaagc

SEQ ID NO: 621 - RNA, 22 nt, Drosophila melanogaster
ugucuuuuuccgcuuacuggcg

SEQ ID NO: 622 - RNA, 24 nt, Drosophila melanogaster
ugaacacagcuggugguauccagu

SEQ ID NO: 623 - RNA, 22 nt, Drosophila melanogaster
ucacugggcuuuguuuaucuca

SEQ ID NO: 624 - RNA, 23 nt, Drosophila melanogaster
uggcaagaugucggcauagcuga

SEQ ID NO: 625 - RNA, 22 nt, Drosophila melanogaster
uggcaagaugucggaauagcug

SEQ ID NO: 626 - RNA, 21 nt, Drosophila melanogaster
aggugcauuguagucgcauug

SEQ ID NO: 627 - RNA, 22 nt, Drosophila melanogaster
uggcagugugguuagcugguug

SEQ ID NO: 628 - RNA, 21 nt, Drosophila melanogaster
auaaagcuagacaaccauuga

SEQ ID NO: 629 - RNA, 23 nt, Drosophila melanogaster
aaaggaacgaucguugugauaug

SEQ ID NO: 630 - RNA, 22 nt, Drosophila melanogaster
uaucacaguggcuguucuuuuu

SEQ ID NO: 631 - RNA, 23 nt, Drosophila melanogaster
uggaagacuagugauuuuguugu

SEQ ID NO: 632 - RNA, 22 nt, Drosophila melanogaster
uaaagcuagauuaccaaagcau

SEQ ID NO: 633 - RNA, 23 nt, Drosophila melanogaster
uaauacugucagguaaagauguc

SEQ ID NO: 634 - RNA, 21 nt, Drosophila melanogaster
uugagcaaaauuucaggugug

SEQ ID NO: 635 - RNA, 22 nt, Drosophila melanogaster
cauugcacuugucccggccuau

SEQ ID NO: 636 - RNA, 22 nt, Drosophila melanogaster
aauugcacuagucccggccugc

SEQ ID NO: 637 - RNA, 23 nt, Drosophila melanogaster
ucuuugguuaucuagcuguauga

SEQ ID NO: 638 - RNA, 23 nt, Drosophila melanogaster
ucuuuggugauuuuagcuguaug

SEQ ID NO: 639 - RNA, 22 nt, Drosophila melanogaster
ucuuugguauucuagcuguaga

SEQ ID NO: 640 - RNA, 24 nt, Drosophila melanogaster
cgguauaccuucaguauacguaac

SEQ ID NO: 641 - RNA, 22 nt, Drosophila melanogaster
acguauacugaauguauccuga

SEQ ID NO: 642 - RNA, 23 nt, Drosophila pseudoobscura
ugagaucauuuugaaagcugauu

SEQ ID NO: 643 - RNA, 21 nt, Drosophila pseudoobscura
ugagguaguagguuguauagu

SEQ ID NO: 644 - RNA, 22 nt, Drosophila pseudoobscura
uggaauguaaagaaguauggag

SEQ ID NO: 645 - RNA, 21 nt, Drosophila pseudoobscura
acccuguagauccgaauuugu

SEQ ID NO: 646 - RNA, 22 nt, Drosophila pseudoobscura
aacccguaauuccgaacuugug

SEQ ID NO: 647 - RNA, 21 nt, Drosophila pseudoobscura
caucacagucugaguucuugc

SEQ ID NO: 648 - RNA, 23 nt, Drosophila pseudoobscura
ugaguauuacaucagguacuggu

SEQ ID NO: 649 - RNA, 23 nt, Drosophila pseudoobscura
uaaggcacgcggugaaugccaag

SEQ ID NO: 650 - RNA, 22 nt, Drosophila pseudoobscura
ucccugagacccuaacuuguga

SEQ ID NO: 651 - RNA, 22 nt, Drosophila pseudoobscura
uugguccccuucaaccagcugu

SEQ ID NO: 652 - RNA, 22 nt, Drosophila pseudoobscura
uaucacagccauuuugaugagu

SEQ ID NO: 653 - RNA, 22 nt, Drosophila pseudoobscura
uaucacagccauuuugacgagu

SEQ ID NO: 654 - RNA, 21 nt, Drosophila pseudoobscura
ucagucuuuuucucucuccua

SEQ ID NO: 655 - RNA, 22 nt, Drosophila pseudoobscura
uggacggagaacugauaagggc

SEQ ID NO: 656 - RNA, 21 nt, Drosophila pseudoobscura
uugugcgugugacagcggcua

SEQ ID NO: 657 - RNA, 23 nt, Drosophila pseudoobscura
ugauuguccaaacgcaauucuug

SEQ ID NO: 658 - RNA, 24 nt, Drosophila pseudoobscura
guuaauggcacuggaagaauucac

SEQ ID NO: 659 - RNA, 21 nt, Drosophila pseudoobscura
cuuggcacugggagaauucac

SEQ ID NO: 660 - RNA, 26 nt, Drosophila pseudoobscura
uuuugugaccgacacuaacggguaau

SEQ ID NO: 661 - RNA, 23 nt, Drosophila pseudoobscura
ucagguaccugaaguagcgcgcg

SEQ ID NO: 662 - RNA, 22 nt, Drosophila pseudoobscura
uaggaacuucauaccgugcucu

SEQ ID NO: 663 - RNA, 22 nt, Drosophila pseudoobscura
uaggaacuuaauaccgugcucu

SEQ ID NO: 664 - RNA, 23 nt, Drosophila pseudoobscura
uaaaugcacuaucugguacgaca

SEQ ID NO: 665 - RNA, 22 nt, Drosophila pseudoobscura
ucggugggacuuucguccguuu

SEQ ID NO: 666 - RNA, 22 nt, Drosophila pseudoobscura
ugacuagauccacacucauuaa

SEQ ID NO: 667 - RNA, 27 nt, Drosophila pseudoobscura
uguauuuacguugcauaugaaaugaua

SEQ ID NO: 668 - RNA, 23 nt, Drosophila pseudoobscura
ugucauggaauugcucucuuugu

SEQ ID NO: 669 - RNA, 28 nt, Drosophila pseudoobscura
aaucuagccucuacuaggcuuugucugu

SEQ ID NO: 670 - RNA, 21 nt, Drosophila pseudoobscura
uaaauaucagcugguaauucu

SEQ ID NO: 671 - RNA, 29 nt, Drosophila pseudoobscura
ugaagucagcaacuugauuccagcaauug

SEQ ID NO: 672 - RNA, 22 nt, Drosophila pseudoobscura
uagcaccauucgaaaucagugc

SEQ ID NO: 673 - RNA, 23 nt, Drosophila pseudoobscura
ugacuagaccgaacacucgugcu

SEQ ID NO: 674 - RNA, 21 nt, Drosophila pseudoobscura
uguguugaaaaucguuugcac

SEQ ID NO: 675 - RNA, 23 nt, Drosophila pseudoobscura
uuucaugucgauuucauuucaug

SEQ ID NO: 676 - RNA, 26 nt, Drosophila pseudoobscura
uaaauauuuaaguggagccugcgacu

SEQ ID NO: 677 - RNA, 23 nt, Drosophila pseudoobscura
uaucacagccagcuuugaugagc

SEQ ID NO: 678 - RNA, 23 nt, Drosophila pseudoobscura
uaucacagccagcuuugaggagc

SEQ ID NO: 679 - RNA, 23 nt, Drosophila pseudoobscura
uaucacagccagcuuugaugggc

SEQ ID NO: 680 - RNA, 22 nt, Drosophila pseudoobscura
ucacugggcaaagugugucuca

SEQ ID NO: 681 - RNA, 23 nt, Drosophila pseudoobscura
uaaucucaauuuguaaaugugag

SEQ ID NO: 682 - RNA, 23 nt, Drosophila pseudoobscura
auuguacuucaucaggugcucug

SEQ ID NO: 683 - RNA, 22 nt, Drosophila pseudoobscura
ucagguacuuagugacucucaa

SEQ ID NO: 684 - RNA, 20 nt, Drosophila pseudoobscura
ucacaaccuccuugagugag

SEQ ID NO: 685 - RNA, 22 nt, Drosophila pseudoobscura
aaucacaggauuauacugugag

SEQ ID NO: 686 - RNA, 22 nt, Drosophila pseudoobscura
gcacugggugaaguuugucuua

SEQ ID NO: 687 - RNA, 21 nt, Drosophila pseudoobscura
uauucgagccaauaaguucgg

SEQ ID NO: 688 - RNA, 22 nt, Drosophila pseudoobscura
uuuugauuguugcucagaaagc

SEQ ID NO: 689 - RNA, 22 nt, Drosophila pseudoobscura
ugucuuuuuccgcuuacuggcg

SEQ ID NO: 690 - RNA, 24 nt, Drosophila pseudoobscura
ugaacacagcuggugguauccaau

SEQ ID NO: 691 - RNA, 22 nt, Drosophila pseudoobscura
ucacugggcuuuguuuaucuca

SEQ ID NO: 692 - RNA, 23 nt, Drosophila pseudoobscura
uggcaagaugucggcauagcuga

SEQ ID NO: 693 - RNA, 23 nt, Drosophila pseudoobscura
uggcaagaugucggaauagcuga

SEQ ID NO: 694 - RNA, 21 nt, Drosophila pseudoobscura
aggugcauuguagucgcauug

SEQ ID NO: 695 - RNA, 22 nt, Drosophila pseudoobscura
uggcagugugguuagcugguug

SEQ ID NO: 696 - RNA, 21 nt, Drosophila pseudoobscura
auaaagcuagacaaccauuga

SEQ ID NO: 697 - RNA, 23 nt, Drosophila pseudoobscura
aaaggaacgaucguugugauaug

SEQ ID NO: 698 - RNA, 22 nt, Drosophila pseudoobscura
uaucacaguggcuguucuuuuu

SEQ ID NO: 699 - RNA, 23 nt, Drosophila pseudoobscura
uggaagacuagugauuuuguugu

SEQ ID NO: 700 - RNA, 22 nt, Drosophila pseudoobscura
uaaagcuagauuaccaaagcau

SEQ ID NO: 701 - RNA, 23 nt, Drosophila pseudoobscura
uaauacugucagguaaagauguc

SEQ ID NO: 702 - RNA, 21 nt, Drosophila pseudoobscura
uugagcaaaauuucaggugug

SEQ ID NO: 703 - RNA, 22 nt, Drosophila pseudoobscura
cauugcacuugucccggccuau

SEQ ID NO: 704 - RNA, 22 nt, Drosophila pseudoobscura
aauugcacuagucccggccugc

SEQ ID NO: 705 - RNA, 23 nt, Drosophila pseudoobscura
ucuuugguuaucuagcuguauga

SEQ ID NO: 706 - RNA, 23 nt, Drosophila pseudoobscura
ucuuuggugauuuuagcuguaug

SEQ ID NO: 707 - RNA, 22 nt, Drosophila pseudoobscura
ucuuugguauucuagcuguaga

SEQ ID NO: 708 - RNA, 24 nt, Drosophila pseudoobscura
cgguauaccuucaguauacguaac

SEQ ID NO: 709 - RNA, 22 nt, Drosophila pseudoobscura
acguauacugaauguauccuga

SEQ ID NO: 710 - RNA, 22 nt, Danio rerio
ugagguaguagguuguauaguu

SEQ ID NO: 711 - RNA, 22 nt, Danio rerio
ugagguaguagguugugugguu

SEQ ID NO: 712 - RNA, 22 nt, Danio rerio
ugagguaguagguuguaugguu

SEQ ID NO: 713 - RNA, 22 nt, Danio rerio
ugagguaguugguuguaugguu

SEQ ID NO: 714 - RNA, 22 nt, Danio rerio
ugagguaguagauugaauaguu

SEQ ID NO: 715 - RNA, 22 nt, Danio rerio
ugagguaguagauuguauaguu

SEQ ID NO: 716 - RNA, 22 nt, Danio rerio
ugagguaguaguuuguauaguu

SEQ ID NO: 717 - RNA, 22 nt, Danio rerio
ugagguaguaaguuguguuguu

SEQ ID NO: 718 - RNA, 22 nt, Danio rerio
ugagguaguaguuugugcuguu

SEQ ID NO: 719 - RNA, 22 nt, Danio rerio
ugagguaguuguuuguacaguu

SEQ ID NO: 720 - RNA, 22 nt, Danio rerio
uggaauguaaagaaguauguau

SEQ ID NO: 721 - RNA, 22 nt, Danio rerio
aacccguagauccgaacuugug

SEQ ID NO: 722 - RNA, 22 nt, Danio rerio
uacaguacugugauaacugaag

SEQ ID NO: 723 - RNA, 22 nt, Danio rerio
uacaguacuaugauaacugaag

SEQ ID NO: 724 - RNA, 23 nt, Danio rerio
agcagcauuguacagggcuauga

SEQ ID NO: 725 - RNA, 23 nt, Danio rerio
agcagcauuguacagggcuauca

SEQ ID NO: 726 - RNA, 22 nt, Danio rerio
uacccuguagauccgaauuugu

SEQ ID NO: 727 - RNA, 22 nt, Danio rerio
caaauucgugucuuggggaaua

SEQ ID NO: 728 - RNA, 23 nt, Danio rerio
uacccuguagaaccgaauuugug

SEQ ID NO: 729 - RNA, 22 nt, Danio rerio
uacccuguagauccggauuugu

SEQ ID NO: 730 - RNA, 23 nt, Danio rerio
uacccuguagaaccgaaugugug

SEQ ID NO: 731 - RNA, 22 nt, Danio rerio
cagauucgguuuuaggggagua

SEQ ID NO: 732 - RNA, 22 nt, Danio rerio
uggagugugacaaugguguuug

SEQ ID NO: 733 - RNA, 22 nt, Danio rerio
uaaggcacgcggugaaugccaa

SEQ ID NO: 734 - RNA, 22 nt, Danio rerio
ucccugagacccuuaaccugug

SEQ ID NO: 735 - RNA, 22 nt, Danio rerio
ucccugagacccuaacuuguga

SEQ ID NO: 736 - RNA, 22 nt, Danio rerio
ucccugagacccuaacucguga

SEQ ID NO: 737 - RNA, 21 nt, Danio rerio
ucguaccgugaguaauaaugc

SEQ ID NO: 738 - RNA, 21 nt, Danio rerio
cauuauuacuuuugguacgcg

SEQ ID NO: 739 - RNA, 22 nt, Danio rerio
ucacagugaaccggucucuuuu

SEQ ID NO: 740 - RNA, 22 nt, Danio rerio
cuuuuugcggucugggcuugcu

SEQ ID NO: 741 - RNA, 22 nt, Danio rerio
aagcccuuaccccaaaaagcau

SEQ ID NO: 742 - RNA, 22 nt, Danio rerio
cagugcaauguuaaaagggcau

SEQ ID NO: 743 - RNA, 22 nt, Danio rerio
cagugcaauaaugaaagggcau

SEQ ID NO: 744 - RNA, 22 nt, Danio rerio
cagugcaauauuaaaagggcau

SEQ ID NO: 745 - RNA, 22 nt, Danio rerio
uaacagucuacagccauggucg

SEQ ID NO: 746 - RNA, 22 nt, Danio rerio
accguggcauuagauuguuacu

SEQ ID NO: 747 - RNA, 22 nt, Danio rerio
uuugguccccuucaaccagcug

SEQ ID NO: 748 - RNA, 22 nt, Danio rerio
agcugguaaaauggaaccaaau

SEQ ID NO: 749 - RNA, 22 nt, Danio rerio
uuugguccccuucaaccagcua

SEQ ID NO: 750 - RNA, 22 nt, Danio rerio
gcuggucaaauggaaccaaguc

SEQ ID NO: 751 - RNA, 22 nt, Danio rerio
uuuggucccuuucaaccagcua

SEQ ID NO: 752 - RNA, 23 nt, Danio rerio
uauggcuuuuuauuccuauguga

SEQ ID NO: 753 - RNA, 22 nt, Danio rerio
uauggcuuuuuauuccuaucug

SEQ ID NO: 754 - RNA, 22 nt, Danio rerio
uauggcuuucuauuccuaugug

SEQ ID NO: 755 - RNA, 22 nt, Danio rerio
uuauugcuuaagaauacgcgua

SEQ ID NO: 756 - RNA, 22 nt, Danio rerio
agcugguguugugaaucaggcc

SEQ ID NO: 757 - RNA, 18 nt, Danio rerio
ucuacagugcaugugucu

SEQ ID NO: 758 - RNA, 22 nt, Danio rerio
cagugguuuuacccuaugguag

SEQ ID NO: 759 - RNA, 23 nt, Danio rerio
uaccacaggguagaaccacggac

SEQ ID NO: 760 - RNA, 22 nt, Danio rerio
uaacacugucugguaacgaugc

SEQ ID NO: 761 - RNA, 23 nt, Danio rerio
uguaguguuuccuacuuuaugga

SEQ ID NO: 762 - RNA, 21 nt, Danio rerio
cauaaaguagaaagcacuacu

SEQ ID NO: 763 - RNA, 22 nt, Danio rerio
cauaaaguagacagcacuacua

SEQ ID NO: 764 - RNA, 21 nt, Danio rerio
ugagaugaagcacuguagcuc

SEQ ID NO: 765 - RNA, 20 nt, Danio rerio
uacaguauagaugauguacu

SEQ ID NO: 766 - RNA, 22 nt, Danio rerio
guccaguuuucccaggaauccc

SEQ ID NO: 767 - RNA, 23 nt, Danio rerio
ugagaacugaauuccauagaugg

SEQ ID NO: 768 - RNA, 22 nt, Danio rerio
ugagaacugaauuccaagggug

SEQ ID NO: 769 - RNA, 22 nt, Danio rerio
ucagugcauuacagaacuuugu

SEQ ID NO: 770 - RNA, 22 nt, Danio rerio
ucucccaauccuuguaccagug

SEQ ID NO: 771 - RNA, 22 nt, Danio rerio
ucagugcaugacagaacuuugg

SEQ ID NO: 772 - RNA, 22 nt, Danio rerio
uugcauagucacaaaagugauc

SEQ ID NO: 773 - RNA, 22 nt, Danio rerio
uugcauagucacaaaaaugagc

SEQ ID NO: 774 - RNA, 22 nt, Danio rerio
uugcauagucacaaaaaugauc

SEQ ID NO: 775 - RNA, 22 nt, Danio rerio
uuaaugcuaaucgugauagggg

SEQ ID NO: 776 - RNA, 22 nt, Danio rerio
uagcagcacagaaugguuugug

SEQ ID NO: 777 - RNA, 22 nt, Danio rerio
caggccguacugugcugcggca

SEQ ID NO: 778 - RNA, 22 nt, Danio rerio
uagcagcacaucaugguuugua

SEQ ID NO: 779 - RNA, 21 nt, Danio rerio
aagcagcgcgucaugguuuuc

SEQ ID NO: 780 - RNA, 22 nt, Danio rerio
uagcagcacguaaauauuggug

SEQ ID NO: 781 - RNA, 22 nt, Danio rerio
uagcagcacguaaauauuggag

SEQ ID NO: 782 - RNA, 22 nt, Danio rerio
uagcagcauguaaauauuggag

SEQ ID NO: 783 - RNA, 22 nt, Danio rerio
caaagugcuuacagugcaggua

SEQ ID NO: 784 - RNA, 22 nt, Danio rerio
acugcaguggaggcacuucuag

SEQ ID NO: 785 - RNA, 23 nt, Danio rerio
aacauucaacgcugucggugagu

SEQ ID NO: 786 - RNA, 22 nt, Danio rerio
accaucgaccguugauuguacc

SEQ ID NO: 787 - RNA, 22 nt, Danio rerio
aacauucauugcugucgguggg

SEQ ID NO: 788 - RNA, 22 nt, Danio rerio
cacauucauugcugucgguggg

SEQ ID NO: 789 - RNA, 22 nt, Danio rerio
uuuggcaaugguagaacucaca

SEQ ID NO: 790 - RNA, 21 nt, Danio rerio
ugguucuagacuugccaacua

SEQ ID NO: 791 - RNA, 23 nt, Danio rerio
uauggcacugguagaauucacug

SEQ ID NO: 792 - RNA, 22 nt, Danio rerio
uggacggagaacugauaagggc

SEQ ID NO: 793 - RNA, 20 nt, Danio rerio
ucgugucuuguguugcagcc

SEQ ID NO: 794 - RNA, 22 nt, Danio rerio
uaaggugcaucuagugcagaua

SEQ ID NO: 795 - RNA, 22 nt, Danio rerio
uaaggugcauuuagugcagaua

SEQ ID NO: 796 - RNA, 22 nt, Danio rerio
cugcccuaagugccccuucugg

SEQ ID NO: 797 - RNA, 22 nt, Danio rerio
uaaggugcaucuuguguaguua

SEQ ID NO: 798 - RNA, 22 nt, Danio rerio
ugauauguuugauauauuaggu

SEQ ID NO: 799 - RNA, 22 nt, Danio rerio
ugauauguuugauauucgguug

SEQ ID NO: 800 - RNA, 21 nt, Danio rerio
augaccuaugaauugacagcc

SEQ ID NO: 801 - RNA, 22 nt, Danio rerio
aacuggccuacaaagucccagu

SEQ ID NO: 802 - RNA, 22 nt, Danio rerio
aacuggcccgcaaagucccgcu

SEQ ID NO: 803 - RNA, 21 nt, Danio rerio
uguaacagcaacuccaugugg

SEQ ID NO: 804 - RNA, 22 nt, Danio rerio
uguaacagccgcuccaugugga

SEQ ID NO: 805 - RNA, 22 nt, Danio rerio
uagguaguuucauguuguuggg

SEQ ID NO: 806 - RNA, 22 nt, Danio rerio
uagguaguuucaaguuguuggg

SEQ ID NO: 807 - RNA, 23 nt, Danio rerio
cccaguguucagacuaccuguuc

SEQ ID NO: 808 - RNA, 22 nt, Danio rerio
uacaguagucugcacauugguu

SEQ ID NO: 809 - RNA, 23 nt, Danio rerio
ugugcaaaucuaugcaaaacuga

SEQ ID NO: 810 - RNA, 22 nt, Danio rerio
cuaguuuugcauaguugcacua

SEQ ID NO: 811 - RNA, 23 nt, Danio rerio
ugugcaaauccaugcaaaacuga

SEQ ID NO: 812 - RNA, 22 nt, Danio rerio
aguuuugcugguuugcauucag

SEQ ID NO: 813 - RNA, 23 nt, Danio rerio
ugugcaaauccaugcaaaacucg

SEQ ID NO: 814 - RNA, 23 nt, Danio rerio
ugugcaaacccaugcaaaacuga

SEQ ID NO: 815 - RNA, 22 nt, Danio rerio
uaacacugucugguaacgaugu

SEQ ID NO: 816 - RNA, 22 nt, Danio rerio
uaauacugccugguaaugauga

SEQ ID NO: 817 - RNA, 22 nt, Danio rerio
uaauacugccugguaaugaugc

SEQ ID NO: 818 - RNA, 22 nt, Danio rerio
agaggcauagggcaugggaaaa

SEQ ID NO: 819 - RNA, 22 nt, Danio rerio
uuccuaugcauauaccucuuug

SEQ ID NO: 820 - RNA, 22 nt, Danio rerio
gugaaauguuuaggaccacuug

SEQ ID NO: 821 - RNA, 22 nt, Danio rerio
gugaaauguucaggaccacuug

SEQ ID NO: 822 - RNA, 22 nt, Danio rerio
agugguucucaacaguucaaca

SEQ ID NO: 823 - RNA, 22 nt, Danio rerio
uucccuuugucauccuaugccu

SEQ ID NO: 824 - RNA, 22 nt, Danio rerio
uccuucauuccaccggagucug

SEQ ID NO: 825 - RNA, 22 nt, Danio rerio
uggaauguaaggaagugugugg

SEQ ID NO: 826 - RNA, 23 nt, Danio rerio
uaaagugcuuauagugcagguag

SEQ ID NO: 827 - RNA, 22 nt, Danio rerio
acugcagugugagcacuugaag

SEQ ID NO: 828 - RNA, 23 nt, Danio rerio
caaagugcucacagugcagguag

SEQ ID NO: 829 - RNA, 23 nt, Danio rerio
uagcuuaucagacugguguuggc

SEQ ID NO: 830 - RNA, 22 nt, Danio rerio
cugugcgugugacagcggcuaa

SEQ ID NO: 831 - RNA, 22 nt, Danio rerio
agccacugacuaacgcacauug

SEQ ID NO: 832 - RNA, 21 nt, Danio rerio
uaacagucuacagucauggcu

SEQ ID NO: 833 - RNA, 21 nt, Danio rerio
acagcaggcacagacaggcag

SEQ ID NO: 834 - RNA, 22 nt, Danio rerio
uaaucucagcuggcaacuguga

SEQ ID NO: 835 - RNA, 22 nt, Danio rerio
uaaucucugcaggcaacuguga

SEQ ID NO: 836 - RNA, 22 nt, Danio rerio
uacugcaucaggaacugauugg

SEQ ID NO: 837 - RNA, 22 nt, Danio rerio
uugugcuugaucuaaccaugug

SEQ ID NO: 838 - RNA, 22 nt, Danio rerio
uugugcuugaucuaaccaugca

SEQ ID NO: 839 - RNA, 22 nt, Danio rerio
ugauuguccaaacgcaauucuu

SEQ ID NO: 840 - RNA, 21 nt, Danio rerio
ccacaaccguaucggacacuu

SEQ ID NO: 841 - RNA, 23 nt, Danio rerio
agcuacauugucugcuggguuuc

SEQ ID NO: 842 - RNA, 24 nt, Danio rerio
agcuacaucuggcuacugggucuc

SEQ ID NO: 843 - RNA, 21 nt, Danio rerio
ugucaguuugucaaauacccc

SEQ ID NO: 844 - RNA, 22 nt, Danio rerio
aagcugccagcugaagaacugu

SEQ ID NO: 845 - RNA, 22 nt, Danio rerio
aagcugccaguugaagagcugu

SEQ ID NO: 846 - RNA, 22 nt, Danio rerio
aucacauugccagggauuucca

SEQ ID NO: 847 - RNA, 22 nt, Danio rerio
aucacauugccagggauuacca

SEQ ID NO: 848 - RNA, 22 nt, Danio rerio
uggcucaguucagcaggaacag

SEQ ID NO: 849 - RNA, 22 nt, Danio rerio
cauugcacuugucucggucuga

SEQ ID NO: 850 - RNA, 22 nt, Danio rerio
uucaaguaauccaggauaggcu

SEQ ID NO: 851 - RNA, 22 nt, Danio rerio
uucaaguaauccaggauagguu

SEQ ID NO: 852 - RNA, 22 nt, Danio rerio
uucacaguggcuaaguuccgcu

SEQ ID NO: 853 - RNA, 22 nt, Danio rerio
uucacaguggcuaaguucugca

SEQ ID NO: 854 - RNA, 21 nt, Danio rerio
uucacagugguuaaguucugc

SEQ ID NO: 855 - RNA, 22 nt, Danio rerio
cuuaacccacuugugaacaaug

SEQ ID NO: 856 - RNA, 22 nt, Danio rerio
uucacaguggcuaaguucuuca

SEQ ID NO: 857 - RNA, 22 nt, Danio rerio
uucacaguggcuaaguucagug

SEQ ID NO: 858 - RNA, 22 nt, Danio rerio
uagcaccauuugaaaucgguua

SEQ ID NO: 859 - RNA, 22 nt, Danio rerio
uagcaccauuugaaaucagugu

SEQ ID NO: 860 - RNA, 22 nt, Danio rerio
cagugcaauaguauugucaaag

SEQ ID NO: 861 - RNA, 22 nt, Danio rerio
cagugcaauaguauugucauug

SEQ ID NO: 862 - RNA, 22 nt, Danio rerio
cagugcaauaguauugucauag

SEQ ID NO: 863 - RNA, 22 nt, Danio rerio
uguaaacauucccgacuggaag

SEQ ID NO: 864 - RNA, 22 nt, Danio rerio
uguaaacauccuacacucagcu

SEQ ID NO: 865 - RNA, 22 nt, Danio rerio
uguaaacauccuacacucucag

SEQ ID NO: 866 - RNA, 22 nt, Danio rerio
uguaaacauccccgacuggaag

SEQ ID NO: 867 - RNA, 22 nt, Danio rerio
uguaaacauccuugacuggaag

SEQ ID NO: 868 - RNA, 22 nt, Danio rerio
cuuucagucggauguuugcagc

SEQ ID NO: 869 - RNA, 21 nt, Danio rerio
ggcaagauguuggcauagcug

SEQ ID NO: 870 - RNA, 22 nt, Danio rerio
uccagcaucagugauuuuguug

SEQ ID NO: 871 - RNA, 22 nt, Danio rerio
uggcagugucuuagcugguugu

SEQ ID NO: 872 - RNA, 23 nt, Danio rerio
uaggcaguguuguuagcugauug

SEQ ID NO: 873 - RNA, 23 nt, Danio rerio
aggcagugcaguuaguugauuac

SEQ ID NO: 874 - RNA, 22 nt, Danio rerio
aauugcacgguauccaucugua

SEQ ID NO: 875 - RNA, 22 nt, Danio rerio
uaaugccccuaaaaauccuuau

SEQ ID NO: 876 - RNA, 22 nt, Danio rerio
uuuguucguucggcucgcguua

SEQ ID NO: 877 - RNA, 22 nt, Danio rerio
uaauacugucugguaaugccgu

SEQ ID NO: 878 - RNA, 22 nt, Danio rerio
uaagugcuauuuguugggguag

SEQ ID NO: 879 - RNA, 23 nt, Danio rerio
aaagugcuaucaaguugggguag

SEQ ID NO: 880 - RNA, 22 nt, Danio rerio
uaagugcuucucuuugggguag

SEQ ID NO: 881 - RNA, 22 nt, Danio rerio
uaagugcuauuuguuggcguag

SEQ ID NO: 882 - RNA, 22 nt, Danio rerio
aaagugcuaucaaauuggggua

SEQ ID NO: 883 - RNA, 22 nt, Danio rerio
aaaccguuaccauuacugaguu

SEQ ID NO: 884 - RNA, 22 nt, Danio rerio
uagugcaauauugcuaauaggg

SEQ ID NO: 885 - RNA, 22 nt, Danio rerio
uagugcaauauugcuuauaggg

SEQ ID NO: 886 - RNA, 22 nt, Danio rerio
uaugugcccuuggacuacaucg

SEQ ID NO: 887 - RNA, 22 nt, Danio rerio
caggcugguuagaugguuguca

SEQ ID NO: 888 - RNA, 22 nt, Danio rerio
aagcagcacaucaauauuggca

SEQ ID NO: 889 - RNA, 22 nt, Danio rerio
aagcagcacauaaauacuggag

SEQ ID NO: 890 - RNA, 22 nt, Danio rerio
auagcucuuugaaugguacugc

SEQ ID NO: 891 - RNA, 22 nt, Danio rerio
ucaguaacaaggauucauccug

SEQ ID NO: 892 - RNA, 22 nt, Danio rerio
cagggaaucucuguuacugggg

SEQ ID NO: 893 - RNA, 22 nt, Danio rerio
cacagcgcauacaauguggaug

SEQ ID NO: 894 - RNA, 22 nt, Danio rerio
ccugcauuguacacacugugcg

SEQ ID NO: 895 - RNA, 22 nt, Danio rerio
ucaggaaugggcuaaaugccaa

SEQ ID NO: 896 - RNA, 22 nt, Danio rerio
uaacggaacccauaaugcagcu

SEQ ID NO: 897 - RNA, 23 nt, Danio rerio
agugacaucauauguacggcugc

SEQ ID NO: 898 - RNA, 22 nt, Danio rerio
uuaagacuugcagugauguuua

SEQ ID NO: 899 - RNA, 24 nt, Danio rerio
uuuuuugcagaaacguuucagauu

SEQ ID NO: 900 - RNA, 23 nt, Danio rerio
aagacaucaauuaaaucugugcu

SEQ ID NO: 901 - RNA, 24 nt, Danio rerio
gacaguuuuaaaugauguuacuuu

SEQ ID NO: 902 - RNA, 22 nt, Danio rerio
uuaaagggaauuugcgacuguu

SEQ ID NO: 903 - RNA, 22 nt, Danio rerio
uucagucauuguuucuaguagu

SEQ ID NO: 904 - RNA, 21 nt, Danio rerio
uucacuacuagcagaacucgg

SEQ ID NO: 905 - RNA, 22 nt, Danio rerio
guugaggcgaguugaagacuua

SEQ ID NO: 906 - RNA, 22 nt, Danio rerio
ucagucuucaauuccucccagc

SEQ ID NO: 907 - RNA, 22 nt, Danio rerio
auacuaaguacacuacguuuuc

SEQ ID NO: 908 - RNA, 24 nt, Danio rerio
cauggguaugauacgaccuggguu

SEQ ID NO: 909 - RNA, 23 nt, Danio rerio
uccucauugugcaugcugugugu

SEQ ID NO: 910 - RNA, 24 nt, Danio rerio
aaugacacguuuucucccggaucg

SEQ ID NO: 911 - RNA, 22 nt, Danio rerio
cucaaagcagagaacucucggu

SEQ ID NO: 912 - RNA, 23 nt, Danio rerio
ugcguugguuuagcucagugguu

SEQ ID NO: 913 - RNA, 23 nt, Danio rerio
guaaaugcugcagaaucguaccg

SEQ ID NO: 914 - RNA, 22 nt, Danio rerio
cucucccaccgcuaaacuugac

SEQ ID NO: 915 - RNA, 21 nt, Danio rerio
guaagacgaacaaaaaguuuu

SEQ ID NO: 916 - RNA, 21 nt, Danio rerio
aaucaaaaccuaaagaaaaua

SEQ ID NO: 917 - RNA, 23 nt, Danio rerio
gcuacggcccgcgucgggaccuc

SEQ ID NO: 918 - RNA, 21 nt, Danio rerio
aggccgaaguggagaaggguu

SEQ ID NO: 919 - RNA, 22 nt, Danio rerio
auaaaaagugguaugguacagu

SEQ ID NO: 920 - RNA, 23 nt, Danio rerio
uggaagacuagugauuuuguugu

SEQ ID NO: 921 - RNA, 21 nt, Danio rerio
uggaagacuugugauuuuguu

SEQ ID NO: 922 - RNA, 23 nt, Danio rerio
ucuuugguuaucuagcuguauga

SEQ ID NO: 923 - RNA, 21 nt, Danio rerio
uaaagcuagauaaccgaaagu

SEQ ID NO: 924 - RNA, 22 nt, Danio rerio
uauugcacuugucccggccugu

SEQ ID NO: 925 - RNA, 22 nt, Danio rerio
uauugcacucgucccggccucc

SEQ ID NO: 926 - RNA, 22 nt, Danio rerio
aaaagugcuguuugugcaggua

SEQ ID NO: 927 - RNA, 23 nt, Danio rerio
uuuggcacuagcacauuuuugcu

SEQ ID NO: 928 - RNA, 22 nt, Danio rerio
aacccguagauccgaucuugug

SEQ ID NO: 929 - RNA, 23 nt, Epstein Barr virus
uagcaccgcuauccacuaugucu

SEQ ID NO: 930 - RNA, 23 nt, Epstein Barr virus
ucuuaguggaagugacgugcugu

SEQ ID NO: 931 - RNA, 22 nt, Epstein Barr virus
acauaaccauggaguuggcugu

SEQ ID NO: 932 - RNA, 21 nt, Epstein Barr virus
acgcacaccaggcugacugcc

SEQ ID NO: 933 - RNA, 22 nt, Epstein Barr virus
gacaguuuggugcgcuaguugu

SEQ ID NO: 934 - RNA, 23 nt, Epstein Barr virus
uccugugguguuuggugugguuu

SEQ ID NO: 935 - RNA, 23 nt, Epstein Barr virus
uguaacuugccagggacggcuga

SEQ ID NO: 936 - RNA, 22 nt, Epstein Barr virus
uaaaugcugcaguaguagggau

SEQ ID NO: 937 - RNA, 22 nt, Epstein Barr virus
uacccuacgcugccgauuuaca

SEQ ID NO: 938 - RNA, 22 nt, Epstein Barr virus
agugguuuuguuuccuugauag

SEQ ID NO: 939 - RNA, 22 nt, Epstein Barr virus
auagagugggugugugcucuug

SEQ ID NO: 940 - RNA, 22 nt, Epstein Barr virus
uuguaugccugguguccccuua

SEQ ID NO: 941 - RNA, 22 nt, Epstein Barr virus
aagaggacgcaggcauacaagg

SEQ ID NO: 942 - RNA, 22 nt, Epstein Barr virus
caaguucgcacuuccuauacag

SEQ ID NO: 943 - RNA, 22 nt, Epstein Barr virus
uguuuuguuugcuugggaaugc

SEQ ID NO: 944 - RNA, 22 nt, Epstein Barr virus
uauuuucugcauucgcccuugc

SEQ ID NO: 945 - RNA, 22 nt, Epstein Barr virus
caugaaggcacagccuguuacc

SEQ ID NO: 946 - RNA, 22 nt, Epstein Barr virus
guagcaggcaugucuucauucc

SEQ ID NO: 947 - RNA, 22 nt, Epstein Barr virus
cgcaccacuagucaccaggugu

SEQ ID NO: 948 - RNA, 22 nt, Epstein Barr virus
aaccuaguguuaguguugugcu

SEQ ID NO: 949 - RNA, 22 nt, Epstein Barr virus
gaccugaugcugcuggugugcu

SEQ ID NO: 950 - RNA, 24 nt, Epstein Barr virus
caaggugaauauagcugcccaucg

SEQ ID NO: 951 - RNA, 22 nt, Epstein Barr virus
cggggaucggacuagccuuaga

SEQ ID NO: 952 - RNA, 22 nt, Epstein Barr virus
gguugguccaauccauaggcuu

SEQ ID NO: 953 - RNA, 22 nt, Epstein Barr virus
caucauaguccaguguccaggg

SEQ ID NO: 954 - RNA, 22 nt, Epstein Barr virus
gucacaaucuauggggucguag

SEQ ID NO: 955 - RNA, 22 nt, Epstein Barr virus
uacgguuuccuagauuguacag

SEQ ID NO: 956 - RNA, 22 nt, Epstein Barr virus
uaacacuucaugggucccguag

SEQ ID NO: 957 - RNA, 22 nt, Epstein Barr virus
uaaccugaucagccccggaguu

SEQ ID NO: 958 - RNA, 23 nt, Epstein Barr virus
uaucuuuugcggcagaaauugaa

SEQ ID NO: 959 - RNA, 22 nt, Epstein Barr virus
aaauucuguugcagcagauagc

SEQ ID NO: 960 - RNA, 23 nt, Epstein Barr virus
uaacgggaaguguguaagcacac

SEQ ID NO: 961 - RNA, 22 nt, Fugu rubripes
ugagguaguagguuguauaguu

SEQ ID NO: 962 - RNA, 22 nt, Fugu rubripes
ugagguaguagguugugugguu

SEQ ID NO: 963 - RNA, 22 nt, Fugu rubripes
ugagguaguugguuguaugguu

SEQ ID NO: 964 - RNA, 22 nt, Fugu rubripes
ugagguaguagauugaauaguu

SEQ ID NO: 965 - RNA, 22 nt, Fugu rubripes
ugagguaguaguuuguauaguu

SEQ ID NO: 966 - RNA, 22 nt, Fugu rubripes
ugagguaguaaguuguguuguu

SEQ ID NO: 967 - RNA, 22 nt, Fugu rubripes
ugagguaguaguuugugcuguu

SEQ ID NO: 968 - RNA, 22 nt, Fugu rubripes
ugagguaguuuuuuguacaguu

SEQ ID NO: 969 - RNA, 22 nt, Fugu rubripes
uggaauguaaagaaguauguau

SEQ ID NO: 970 - RNA, 22 nt, Fugu rubripes
aacccguagauccgaacuugug

SEQ ID NO: 971 - RNA, 22 nt, Fugu rubripes
uacaguacugugauaacugaag

SEQ ID NO: 972 - RNA, 22 nt, Fugu rubripes
uacaguacuaugauaacugaag

SEQ ID NO: 973 - RNA, 23 nt, Fugu rubripes
agcagcauuguacagggcuauga

SEQ ID NO: 974 - RNA, 23 nt, Fugu rubripes
agcagcauuguacagggcuauca

SEQ ID NO: 975 - RNA, 23 nt, Fugu rubripes
uacccuguagaaccgaauuugug

SEQ ID NO: 976 - RNA, 22 nt, Fugu rubripes
uacccuguagauccggauuugu

SEQ ID NO: 977 - RNA, 25 nt, Fugu rubripes
uacccuguagaaccgaaugugugug

SEQ ID NO: 978 - RNA, 22 nt, Fugu rubripes
uggagugugacaaugguguuug

SEQ ID NO: 979 - RNA, 22 nt, Fugu rubripes
uaaggcacgcggugaaugccaa

SEQ ID NO: 980 - RNA, 22 nt, Fugu rubripes
ucccugagacccuuaaccugug

SEQ ID NO: 981 - RNA, 22 nt, Fugu rubripes
ucccugagacccuaacuuguga

SEQ ID NO: 982 - RNA, 21 nt, Fugu rubripes
ucguaccgugaguaauaaugc

SEQ ID NO: 983 - RNA, 22 nt, Fugu rubripes
ucacagugaaccggucucuuuu

SEQ ID NO: 984 - RNA, 22 nt, Fugu rubripes
cuuuuugcggucugggcuugcu

SEQ ID NO: 985 - RNA, 22 nt, Fugu rubripes
cagugcaauauuaaaagggcau

SEQ ID NO: 986 - RNA, 22 nt, Fugu rubripes
uaacagucuacagccauggucg

SEQ ID NO: 987 - RNA, 22 nt, Fugu rubripes
uuugguccccuucaaccagcug

SEQ ID NO: 988 - RNA, 22 nt, Fugu rubripes
uauggcuuucuauuccuaugug

SEQ ID NO: 989 - RNA, 22 nt, Fugu rubripes
uauggcuuuuuauuccuaucug

SEQ ID NO: 990 - RNA, 22 nt, Fugu rubripes
uuauugcuuaagaauacgcgua

SEQ ID NO: 991 - RNA, 22 nt, Fugu rubripes
agcugguguugugaaucaggcc

SEQ ID NO: 992 - RNA, 22 nt, Fugu rubripes
cagugguuuuacccuaugguag

SEQ ID NO: 993 - RNA, 21 nt, Fugu rubripes
cauaaaguagaaagcacuacu

SEQ ID NO: 994 - RNA, 22 nt, Fugu rubripes
cauaaaguagaaagcacuacua

SEQ ID NO: 995 - RNA, 20 nt, Fugu rubripes
uacaguauagaugauguacu

SEQ ID NO: 996 - RNA, 22 nt, Fugu rubripes
ucagugcauuacagaacuuugu

SEQ ID NO: 997 - RNA, 22 nt, Fugu rubripes
ucagugcauaacagaacuuugu

SEQ ID NO: 998 - RNA, 22 nt, Fugu rubripes
uugcauagucacaaaagugauc

SEQ ID NO: 999 - RNA, 22 nt, Fugu rubripes
uugcauagucacaaaaaugagc

SEQ ID NO: 1000 - RNA, 22 nt, Fugu rubripes
uagcagcacggaaugguuugug

SEQ ID NO: 1001 - RNA, 22 nt, Fugu rubripes
uagcagcgcaucaugguuugua

SEQ ID NO: 1002 - RNA, 22 nt, Fugu rubripes
uagcagcacguaaauauuggag

SEQ ID NO: 1003 - RNA, 22 nt, Fugu rubripes
caaagugcuuacagugcaggua

SEQ ID NO: 1004 - RNA, 22 nt, Fugu rubripes
uaaggugcaucuagugcagaua

SEQ ID NO: 1005 - RNA, 23 nt, Fugu rubripes
aacauucaacgcugucggugagu

SEQ ID NO: 1006 - RNA, 22 nt, Fugu rubripes
accaucgaccguugauuguacc

SEQ ID NO: 1007 - RNA, 22 nt, Fugu rubripes
aacauucauugcugucgguggg

SEQ ID NO: 1008 - RNA, 21 nt, Fugu rubripes
ugguucuagacuugccaacua

SEQ ID NO: 1009 - RNA, 23 nt, Fugu rubripes
uauggcacugguagaauucacug

SEQ ID NO: 1010 - RNA, 21 nt, Fugu rubripes
uggacggagaacugauaaggg

SEQ ID NO: 1011 - RNA, 20 nt, Fugu rubripes
ucgugucuuguguugcagcc

SEQ ID NO: 1012 - RNA, 23 nt, Fugu rubripes
gugccuacugaacugguaucagu

SEQ ID NO: 1013 - RNA, 22 nt, Fugu rubripes
ugauauguuugauauauuaggu

SEQ ID NO: 1014 - RNA, 21 nt, Fugu rubripes
augaccuaugaauugacagcc

SEQ ID NO: 1015 - RNA, 22 nt, Fugu rubripes
aacuggccuacaaagucccagu

SEQ ID NO: 1016 - RNA, 21 nt, Fugu rubripes
uguaacagcaacuccaugugg

SEQ ID NO: 1017 - RNA, 22 nt, Fugu rubripes
uagguaguuucauguuguuggg

SEQ ID NO: 1018 - RNA, 22 nt, Fugu rubripes
uagguaguuucaaguuguuggg

SEQ ID NO: 1019 - RNA, 23 nt, Fugu rubripes
cccaguguucagacuaccuguuc

SEQ ID NO: 1020 - RNA, 23 nt, Fugu rubripes
ugugcaaaucuaugcaaaacuga

SEQ ID NO: 1021 - RNA, 23 nt, Fugu rubripes
ugugcaaauccaugcaaaacuga

SEQ ID NO: 1022 - RNA, 23 nt, Fugu rubripes
uaaagugcuuauagugcagguag

SEQ ID NO: 1023 - RNA, 22 nt, Fugu rubripes
uaacacugucugguaacgaugu

SEQ ID NO: 1024 - RNA, 22 nt, Fugu rubripes
uaauacugccugguaaugauga

SEQ ID NO: 1025 - RNA, 22 nt, Fugu rubripes
agaggcauagggcaugggaaaa

SEQ ID NO: 1026 - RNA, 22 nt, Fugu rubripes
gugaaauguuuaggaccacuug

SEQ ID NO: 1027 - RNA, 22 nt, Fugu rubripes
uucccuuugucauccuaugccu

SEQ ID NO: 1028 - RNA, 22 nt, Fugu rubripes
uccuucauuccaccggagucug

SEQ ID NO: 1029 - RNA, 23 nt, Fugu rubripes
uagcuuaucagacugguguuggc

SEQ ID NO: 1030 - RNA, 22 nt, Fugu rubripes
cugugcgugugacagcggcuaa

SEQ ID NO: 1031 - RNA, 21 nt, Fugu rubripes
uaacagucuacagucauggcu

SEQ ID NO: 1032 - RNA, 21 nt, Fugu rubripes
acagcaggcacagacaggcag

SEQ ID NO: 1033 - RNA, 22 nt, Fugu rubripes
aaaucucagcuggcaacuguga

SEQ ID NO: 1034 - RNA, 22 nt, Fugu rubripes
uaaucucugcaggcaacuguga

SEQ ID NO: 1035 - RNA, 22 nt, Fugu rubripes
uacugcaucaggaacugauugg

SEQ ID NO: 1036 - RNA, 22 nt, Fugu rubripes
uugugcuugaucuaaccaugug

SEQ ID NO: 1037 - RNA, 22 nt, Fugu rubripes
uugugcuugaucuaaccaugca

SEQ ID NO: 1038 - RNA, 22 nt, Fugu rubripes
ugauuguccaaacgcaauucuu

SEQ ID NO: 1039 - RNA, 23 nt, Fugu rubripes
agcuacauugucugcuggguuuc

SEQ ID NO: 1040 - RNA, 24 nt, Fugu rubripes
agcuacaucuggcuacugggucuc

SEQ ID NO: 1041 - RNA, 21 nt, Fugu rubripes
ugucaguuugucaaauacccc

SEQ ID NO: 1042 - RNA, 22 nt, Fugu rubripes
aagcugccagcugaagaacugu

SEQ ID NO: 1043 - RNA, 22 nt, Fugu rubripes
aagcugccaguugaagagcugu

SEQ ID NO: 1044 - RNA, 22 nt, Fugu rubripes
aucacauugccagggauuucca

SEQ ID NO: 1045 - RNA, 22 nt, Fugu rubripes
aucacauugccagggauuacca

SEQ ID NO: 1046 - RNA, 22 nt, Fugu rubripes
uggcucaguucagcaggaacag

SEQ ID NO: 1047 - RNA, 22 nt, Fugu rubripes
cauugcacuugucucggucuga

SEQ ID NO: 1048 - RNA, 22 nt, Fugu rubripes
uucaaguaauccaggauaggcu

SEQ ID NO: 1049 - RNA, 22 nt, Fugu rubripes
uucacaguggcuaaguucugca

SEQ ID NO: 1050 - RNA, 21 nt, Fugu rubripes
uucacagugguuaaguucugc

SEQ ID NO: 1051 - RNA, 22 nt, Fugu rubripes
uucacaguggcuaaguucagug

SEQ ID NO: 1052 - RNA, 22 nt, Fugu rubripes
uagcaccauuugaaaucgguua

SEQ ID NO: 1053 - RNA, 22 nt, Fugu rubripes
uagcaccauuugaaaucagugu

SEQ ID NO: 1054 - RNA, 22 nt, Fugu rubripes
cagugcaauaguauugucauag

SEQ ID NO: 1055 - RNA, 22 nt, Fugu rubripes
uguaaacauccuacacucagcu

SEQ ID NO: 1056 - RNA, 22 nt, Fugu rubripes
uguaaacauccuacacucucgg

SEQ ID NO: 1057 - RNA, 22 nt, Fugu rubripes
uguaaacauccccgacuggaag

SEQ ID NO: 1058 - RNA, 22 nt, Fugu rubripes
uccagcaucagugauuuuguug

SEQ ID NO: 1059 - RNA, 22 nt, Fugu rubripes
uaaugccccuaaaaauccuuau

SEQ ID NO: 1060 - RNA, 22 nt, Fugu rubripes
uuuguucguucggcucgcguua

SEQ ID NO: 1061 - RNA, 22 nt, Fugu rubripes
uaauacugucugguaaugccgu

SEQ ID NO: 1062 - RNA, 22 nt, Fugu rubripes
uaugugcccuuggacuacaucg

SEQ ID NO: 1063 - RNA, 22 nt, Fugu rubripes
auagcucuuuaaaugguacugc

SEQ ID NO: 1064 - RNA, 22 nt, Fugu rubripes
cacagcgcauacaauguggaug

SEQ ID NO: 1065 - RNA, 23 nt, Fugu rubripes
agugacaucauauguacggcugc

SEQ ID NO: 1066 - RNA, 21 nt, Fugu rubripes
uggaagacuagugauuuuguu

SEQ ID NO: 1067 - RNA, 23 nt, Fugu rubripes
ucuuugguuaucuagcuguauga

SEQ ID NO: 1068 - RNA, 22 nt, Fugu rubripes
uauugcacuugucccggccugu

SEQ ID NO: 1069 - RNA, 23 nt, Fugu rubripes
uuuggcacuagcacauuuuugcu

SEQ ID NO: 1070 - RNA, 22 nt, Gallus gallus
ugagguaguagguuguauaguu

SEQ ID NO: 1071 - RNA, 22 nt, Gallus gallus
ugagguaguagguugugugguu

SEQ ID NO: 1072 - RNA, 22 nt, Gallus gallus
ugagguaguagguuguaugguu

SEQ ID NO: 1073 - RNA, 21 nt, Gallus gallus
agagguaguggguugcauagu

SEQ ID NO: 1074 - RNA, 22 nt, Gallus gallus
ugagguaguagauuguauaguu

SEQ ID NO: 1075 - RNA, 21 nt, Gallus gallus
ugagguaguaguuuguacagu

SEQ ID NO: 1076 - RNA, 21 nt, Gallus gallus
ugagguaguaguuugugcugu

SEQ ID NO: 1077 - RNA, 22 nt, Gallus gallus
ugagguaguagguuguauaguu

SEQ ID NO: 1078 - RNA, 22 nt, Gallus gallus
ugagguaguagauugaauaguu

SEQ ID NO: 1079 - RNA, 22 nt, Gallus gallus
aacccguagauccgaacuugug

SEQ ID NO: 1080 - RNA, 22 nt, Gallus gallus
uacaguacugugauaacugaag

SEQ ID NO: 1081 - RNA, 23 nt, Gallus gallus
agcagcauuguacagggcuauga

SEQ ID NO: 1082 - RNA, 22 nt, Gallus gallus
aaaagugcuuacagugcaggua

SEQ ID NO: 1083 - RNA, 23 nt, Gallus gallus
agcagcauuguacagggcuauca

SEQ ID NO: 1084 - RNA, 22 nt, Gallus gallus
uacccuguagaaccgaauuugu

SEQ ID NO: 1085 - RNA, 23 nt, Gallus gallus
uggagugugacaaugguguuugu

SEQ ID NO: 1086 - RNA, 22 nt, Gallus gallus
uuaaggcacgcggugaaugcca

SEQ ID NO: 1087 - RNA, 22 nt, Gallus gallus
uuaaggcacgcagugaaugcca

SEQ ID NO: 1088 - RNA, 22 nt, Gallus gallus
ucccugagacccuaacuuguga

SEQ ID NO: 1089 - RNA, 23 nt, Gallus gallus
ucguaccgugaguaauaaugcgc

SEQ ID NO: 1090 - RNA, 21 nt, Gallus gallus
cauuauuacuuuugguacgcg

SEQ ID NO: 1091 - RNA, 21 nt, Gallus gallus
ucacagugaaccggucucuuu

SEQ ID NO: 1092 - RNA, 22 nt, Gallus gallus
cagugcaauauuaaaagggcau

SEQ ID NO: 1093 - RNA, 22 nt, Gallus gallus
cagugcaauaaugaaagggcgu

SEQ ID NO: 1094 - RNA, 22 nt, Gallus gallus
uugguccccuucaaccagcugu

SEQ ID NO: 1095 - RNA, 21 nt, Gallus gallus
uugguccccuucaaccagcua

SEQ ID NO: 1096 - RNA, 22 nt, Gallus gallus
uugguccccuucaaccagcugc

SEQ ID NO: 1097 - RNA, 23 nt, Gallus gallus
uauggcuuuuuauuccuauguga

SEQ ID NO: 1098 - RNA, 22 nt, Gallus gallus
uauugcuuaagaauacgcguag

SEQ ID NO: 1099 - RNA, 17 nt, Gallus gallus
agcugguguugugaauc

SEQ ID NO: 1100 - RNA, 21 nt, Gallus gallus
agugguuuuacccuaugguag

SEQ ID NO: 1101 - RNA, 21 nt, Gallus gallus
ccacaggguagaaccacggac

SEQ ID NO: 1102 - RNA, 22 nt, Gallus gallus
uguaguguuuccuacuuuaugg

SEQ ID NO: 1103 - RNA, 22 nt, Gallus gallus
cccauaaaguagaaagcacuac

SEQ ID NO: 1104 - RNA, 22 nt, Gallus gallus
cuacaguauagaugauguacuc

SEQ ID NO: 1105 - RNA, 22 nt, Gallus gallus
ugagaacugaauuccauggguu

SEQ ID NO: 1106 - RNA, 22 nt, Gallus gallus
ugagaacugaauuccauaggcg

SEQ ID NO: 1107 - RNA, 20 nt, Gallus gallus
cccuauggauucaguucugc

SEQ ID NO: 1108 - RNA, 20 nt, Gallus gallus
gugugcggaaaugcuucugc

SEQ ID NO: 1109 - RNA, 22 nt, Gallus gallus
ucagugcacuacagaacuuugu

SEQ ID NO: 1110 - RNA, 20 nt, Gallus gallus
uugcauagucacaaaaguga

SEQ ID NO: 1111 - RNA, 22 nt, Gallus gallus
uuaaugcuaaucgugauagggg

SEQ ID NO: 1112 - RNA, 21 nt, Gallus gallus
uagcagcacauaaugguuugu

SEQ ID NO: 1113 - RNA, 22 nt, Gallus gallus
uagcagcacaucaugguuugca

SEQ ID NO: 1114 - RNA, 22 nt, Gallus gallus
uagcagcacguaaauauuggug

SEQ ID NO: 1115 - RNA, 20 nt, Gallus gallus
acugcagugaaggcacuugu

SEQ ID NO: 1116 - RNA, 24 nt, Gallus gallus
caaagugcuuacagugcagguagu

SEQ ID NO: 1117 - RNA, 23 nt, Gallus gallus
aacauucaacgcugucggugagu

SEQ ID NO: 1118 - RNA, 22 nt, Gallus gallus
accaucgaccguugauuguacc

SEQ ID NO: 1119 - RNA, 22 nt, Gallus gallus
aacauucauugcugucgguggg

SEQ ID NO: 1120 - RNA, 23 nt, Gallus gallus
uauggcacugguagaauucacug

SEQ ID NO: 1121 - RNA, 22 nt, Gallus gallus
uggacggagaacugauaagggu

SEQ ID NO: 1122 - RNA, 20 nt, Gallus gallus
ucgugucuuguguugcagcc

SEQ ID NO: 1123 - RNA, 22 nt, Gallus gallus
uaaggugcaucuagugcagaua

SEQ ID NO: 1124 - RNA, 22 nt, Gallus gallus
uaaggugcaucuagugcaguua

SEQ ID NO: 1125 - RNA, 22 nt, Gallus gallus
ugauauguuugauauauuaggu

SEQ ID NO: 1126 - RNA, 24 nt, Gallus gallus
aacuggcccacaaagucccgcuuu

SEQ ID NO: 1127 - RNA, 22 nt, Gallus gallus
uguaacagcaacuccaugugga

SEQ ID NO: 1128 - RNA, 21 nt, Gallus gallus
uagguaguuucauguuguugg

SEQ ID NO: 1129 - RNA, 23 nt, Gallus gallus
cccaguguucagacuaccuguuc

SEQ ID NO: 1130 - RNA, 20 nt, Gallus gallus
uacaguagucugcacauugg

SEQ ID NO: 1131 - RNA, 23 nt, Gallus gallus
ugugcaaaucuaugcaaaacuga

SEQ ID NO: 1132 - RNA, 23 nt, Gallus gallus
ugugcaaauccaugcaaaacuga

SEQ ID NO: 1133 - RNA, 21 nt, Gallus gallus
uggaauguaaagaaguaugua

SEQ ID NO: 1134 - RNA, 21 nt, Gallus gallus
uggaauguuaagaaguaugua

SEQ ID NO: 1135 - RNA, 22 nt, Gallus gallus
uaacacugucugguaacgaugu

SEQ ID NO: 1136 - RNA, 23 nt, Gallus gallus
uaauacugccugguaaugaugau

SEQ ID NO: 1137 - RNA, 22 nt, Gallus gallus
agaggcauagagcaugggaaaa

SEQ ID NO: 1138 - RNA, 22 nt, Gallus gallus
uuuccuaugcauauacuucuuu

SEQ ID NO: 1139 - RNA, 22 nt, Gallus gallus
gugaaauguuuaggaccacuug

SEQ ID NO: 1140 - RNA, 22 nt, Gallus gallus
uucccuuugucauccuaugccu

SEQ ID NO: 1141 - RNA, 22 nt, Gallus gallus
uccuucauuccaccggagucug

SEQ ID NO: 1142 - RNA, 22 nt, Gallus gallus
cccuucauuccaccggaaucug

SEQ ID NO: 1143 - RNA, 22 nt, Gallus gallus
uggaauguaaggaagugugugg

SEQ ID NO: 1144 - RNA, 23 nt, Gallus gallus
uaaagugcuuauagugcagguag

SEQ ID NO: 1145 - RNA, 23 nt, Gallus gallus
caaagugcucauagugcagguag

SEQ ID NO: 1146 - RNA, 22 nt, Gallus gallus
uagcuuaucagacugauguuga

SEQ ID NO: 1147 - RNA, 22 nt, Gallus gallus
uucccuuugucauccuaugccu

SEQ ID NO: 1148 - RNA, 21 nt, Gallus gallus
augaccuaugaauugacagac

SEQ ID NO: 1149 - RNA, 21 nt, Gallus gallus
uaaucucagcuggcaacugug

SEQ ID NO: 1150 - RNA, 24 nt, Gallus gallus
uacugcaucaggaacugauuggau

SEQ ID NO: 1151 - RNA, 21 nt, Gallus gallus
uugugcuugaucuaaccaugu

SEQ ID NO: 1152 - RNA, 21 nt, Gallus gallus
ugauuguccaaacgcaauucu

SEQ ID NO: 1153 - RNA, 23 nt, Gallus gallus
agcuacauugucugcuggguuuc

SEQ ID NO: 1154 - RNA, 24 nt, Gallus gallus
agcuacaucuggcuacugggucuc

SEQ ID NO: 1155 - RNA, 24 nt, Gallus gallus
aacuacaucuggcuacugggucuc

SEQ ID NO: 1156 - RNA, 21 nt, Gallus gallus
ugucaguuugucaaauacccc

SEQ ID NO: 1157 - RNA, 21 nt, Gallus gallus
aucacauugccagggauuacc

SEQ ID NO: 1158 - RNA, 22 nt, Gallus gallus
uggcucaguucagcaggaacag

SEQ ID NO: 1159 - RNA, 21 nt, Gallus gallus
uucaaguaauccaggauaggc

SEQ ID NO: 1160 - RNA, 21 nt, Gallus gallus
uucacaguggcuaaguucugc

SEQ ID NO: 1161 - RNA, 21 nt, Gallus gallus
uagcaccauuugaaaucgguu

SEQ ID NO: 1162 - RNA, 23 nt, Gallus gallus
uagcaccauuugaaaucaguguu

SEQ ID NO: 1163 - RNA, 20 nt, Gallus gallus
uagcaccauuugaaaucggu

SEQ ID NO: 1164 - RNA, 25 nt, Gallus gallus
cagugcaauaauauugucaaagcau

SEQ ID NO: 1165 - RNA, 22 nt, Gallus gallus
aagugcuuccauguuuuaguga

SEQ ID NO: 1166 - RNA, 23 nt, Gallus gallus
uaagugcuuccauguuuuaguag

SEQ ID NO: 1167 - RNA, 23 nt, Gallus gallus
acuuuaacauggaggugcuuucu

SEQ ID NO: 1168 - RNA, 23 nt, Gallus gallus
uaagugcuuccauguuucagugg

SEQ ID NO: 1169 - RNA, 22 nt, Gallus gallus
uuuaacauggagguaccugcug

SEQ ID NO: 1170 - RNA, 23 nt, Gallus gallus
uaagugcuuccauguuuuaguug

SEQ ID NO: 1171 - RNA, 22 nt, Gallus gallus
cuuucagucggauguuugcagc

SEQ ID NO: 1172 - RNA, 22 nt, Gallus gallus
uguaaacauccucgacuggaag

SEQ ID NO: 1173 - RNA, 22 nt, Gallus gallus
uguaaacauccuacacucagcu

SEQ ID NO: 1174 - RNA, 24 nt, Gallus gallus
uguaaacauccuacacucucagcu

SEQ ID NO: 1175 - RNA, 22 nt, Gallus gallus
uguaaacauccccgacuggaag

SEQ ID NO: 1176 - RNA, 19 nt, Gallus gallus
uguaaacauccuugacugg

SEQ ID NO: 1177 - RNA, 22 nt, Gallus gallus
aggcaagauguuggcauagcug

SEQ ID NO: 1178 - RNA, 21 nt, Gallus gallus
uauugcacauuacuaaguugc

SEQ ID NO: 1179 - RNA, 19 nt, Gallus gallus
gugcauuguaguugcauug

SEQ ID NO: 1180 - RNA, 23 nt, Gallus gallus
uggcagugucuuagcugguuguu

SEQ ID NO: 1181 - RNA, 23 nt, Gallus gallus
caggcaguguaguuagcugauug

SEQ ID NO: 1182 - RNA, 23 nt, Gallus gallus
aggcaguguaguuagcugauugc

SEQ ID NO: 1183 - RNA, 22 nt, Gallus gallus
uaaugccccuaaaaauccuuau

SEQ ID NO: 1184 - RNA, 21 nt, Gallus gallus
aauugcacuuuagcaauggug

SEQ ID NO: 1185 - RNA, 22 nt, Gallus gallus
uuuguucguucggcucgcguua

SEQ ID NO: 1186 - RNA, 22 nt, Gallus gallus
agaucagaaggugauuguggcu

SEQ ID NO: 1187 - RNA, 22 nt, Gallus gallus
uaauacugucugguaaugccgu

SEQ ID NO: 1188 - RNA, 21 nt, Gallus gallus
uggcaguguauguuagcuggu

SEQ ID NO: 1189 - RNA, 23 nt, Gallus gallus
aaaccguuaccauuacugaguuu

SEQ ID NO: 1190 - RNA, 22 nt, Gallus gallus
uaugugcccuuggacuacaucg

SEQ ID NO: 1191 - RNA, 22 nt, Gallus gallus
caggcugguuagaugguuguca

SEQ ID NO: 1192 - RNA, 22 nt, Gallus gallus
ccugcauuguacacacugugug

SEQ ID NO: 1193 - RNA, 23 nt, Gallus gallus
auauauacacacacacauaagac

SEQ ID NO: 1194 - RNA, 23 nt, Gallus gallus
agugacaucauauguacggcugc

SEQ ID NO: 1195 - RNA, 22 nt, Gallus gallus
caaccuggaggacuccaugcug

SEQ ID NO: 1196 - RNA, 23 nt, Gallus gallus
uuaagacuuguagugauguuuag

SEQ ID NO: 1197 - RNA, 22 nt, Gallus gallus
uggaagacuagugauuuuguug

SEQ ID NO: 1198 - RNA, 21 nt, Gallus gallus
gcagagcugcagaugggauuc

SEQ ID NO: 1199 - RNA, 22 nt, Gallus gallus
uggaagacuagugauuuuuguu

SEQ ID NO: 1200 - RNA, 23 nt, Gallus gallus
ucuuugguuaucuagcuguauga

SEQ ID NO: 1201 - RNA, 21 nt, Gallus gallus
uaaagcuagagaaccgaaugu

SEQ ID NO: 1202 - RNA, 21 nt, Gallus gallus
uauugcacuugucccggccug

SEQ ID NO: 1203 - RNA, 22 nt, Gallus gallus
aacccguagauccgaucuugug

SEQ ID NO: 1204 - RNA, 22 nt, Gorilla gorilla
aacccguagauccgaacuugug

SEQ ID NO: 1205 - RNA, 22 nt, Gorilla gorilla
uacaguacugugauaacugaag

SEQ ID NO: 1206 - RNA, 23 nt, Gorilla gorilla
agcagcauuguacagggcuauga

SEQ ID NO: 1207 - RNA, 20 nt, Gorilla gorilla
ucaaaugcucagacuccugu

SEQ ID NO: 1208 - RNA, 24 nt, Gorilla gorilla
aaaagugcuuacagugcagguagc

SEQ ID NO: 1209 - RNA, 21 nt, Gorilla gorilla
uaaagugcugacagugcagau

SEQ ID NO: 1210 - RNA, 23 nt, Gorilla gorilla
agcagcauuguacagggcuauca

SEQ ID NO: 1211 - RNA, 23 nt, Gorilla gorilla
uacccuguagauccgaauuugug

SEQ ID NO: 1212 - RNA, 22 nt, Gorilla gorilla
uacccuguagaaccgaauuugu

SEQ ID NO: 1213 - RNA, 22 nt, Gorilla gorilla
uuaaggcacgcggugaaugcca

SEQ ID NO: 1214 - RNA, 22 nt, Gorilla gorilla
ucccugagacccuaacuuguga

SEQ ID NO: 1215 - RNA, 20 nt, Gorilla gorilla
cagugcaauguuaaaagggc

SEQ ID NO: 1216 - RNA, 22 nt, Gorilla gorilla
uugguccccuucaaccagcugu

SEQ ID NO: 1217 - RNA, 21 nt, Gorilla gorilla
ugugacugguugaccagaggg

SEQ ID NO: 1218 - RNA, 23 nt, Gorilla gorilla
uauggcuuuuuauuccuauguga

SEQ ID NO: 1219 - RNA, 23 nt, Gorilla gorilla
acuccauuuguuuugaugaugga

SEQ ID NO: 1220 - RNA, 21 nt, Gorilla gorilla
aacacugucugguaaagaugg

SEQ ID NO: 1221 - RNA, 22 nt, Gorilla gorilla
ugagaugaagcacuguagcuca

SEQ ID NO: 1222 - RNA, 24 nt, Gorilla gorilla
guccaguuuucccaggaaucccuu

SEQ ID NO: 1223 - RNA, 20 nt, Gorilla gorilla
uugcauagucacaaaaguga

SEQ ID NO: 1224 - RNA, 22 nt, Gorilla gorilla
uagguuauccguguugccuucg

SEQ ID NO: 1225 - RNA, 22 nt, Gorilla gorilla
uagcagcacauaaugguuugug

SEQ ID NO: 1226 - RNA, 22 nt, Gorilla gorilla
uagcagcacaucaugguuuaca

SEQ ID NO: 1227 - RNA, 22 nt, Gorilla gorilla
uagcagcacguaaauauuggcg

SEQ ID NO: 1228 - RNA, 20 nt, Gorilla gorilla
acugcagugaaggcacuugu

SEQ ID NO: 1229 - RNA, 24 nt, Gorilla gorilla
caaagugcuuacagugcagguagu

SEQ ID NO: 1230 - RNA, 22 nt, Gorilla gorilla
uaaggugcaucuagugcagaua

SEQ ID NO: 1231 - RNA, 23 nt, Gorilla gorilla
aacauucaacgcugucggugagu

SEQ ID NO: 1232 - RNA, 22 nt, Gorilla gorilla
accaucgaccguugauuguacc

SEQ ID NO: 1233 - RNA, 24 nt, Gorilla gorilla
aacauucauugcugucgguggguu

SEQ ID NO: 1234 - RNA, 22 nt, Gorilla gorilla
aacauucaaccugucggugagu

SEQ ID NO: 1235 - RNA, 23 nt, Gorilla gorilla
uauggcacugguagaauucacug

SEQ ID NO: 1236 - RNA, 23 nt, Gorilla gorilla
caaagaauucuccuuuugggcuu

SEQ ID NO: 1237 - RNA, 21 nt, Gorilla gorilla
ucgugucuuguguugcagccg

SEQ ID NO: 1238 - RNA, 22 nt, Gorilla gorilla
ugauauguuugauauauuaggu

SEQ ID NO: 1239 - RNA, 22 nt, Gorilla gorilla
uguaacagcaacuccaugugga

SEQ ID NO: 1240 - RNA, 21 nt, Gorilla gorilla
uagcagcacagaaauauuggc

SEQ ID NO: 1241 - RNA, 21 nt, Gorilla gorilla
uagguaguuucauguuguugg

SEQ ID NO: 1242 - RNA, 19 nt, Gorilla gorilla
gguccagaggggagauagg

SEQ ID NO: 1243 - RNA, 23 nt, Gorilla gorilla
cccaguguucagacuaccuguuc

SEQ ID NO: 1244 - RNA, 23 nt, Gorilla gorilla
ugugcaaaucuaugcaaaacuga

SEQ ID NO: 1245 - RNA, 23 nt, Gorilla gorilla
ugugcaaauccaugcaaaacuga

SEQ ID NO: 1246 - RNA, 22 nt, Gorilla gorilla
uaaagugcuuauagugcaggua

SEQ ID NO: 1247 - RNA, 22 nt, Gorilla gorilla
aauacugccggguaaugaugga

SEQ ID NO: 1248 - RNA, 22 nt, Gorilla gorilla
uucccuuugucauccuaugccu

SEQ ID NO: 1249 - RNA, 22 nt, Gorilla gorilla
uccuucauuccaccggagucug

SEQ ID NO: 1250 - RNA, 22 nt, Gorilla gorilla
uagcuuaucagacugauguuga

SEQ ID NO: 1251 - RNA, 21 nt, Gorilla gorilla
acagcaggcacagacaggcag

SEQ ID NO: 1252 - RNA, 21 nt, Gorilla gorilla
augaccuaugaauugacagac

SEQ ID NO: 1253 - RNA, 21 nt, Gorilla gorilla
uaaucucagcuggcaacugug

SEQ ID NO: 1254 - RNA, 24 nt, Gorilla gorilla
uacugcaucaggaacugauuggau

SEQ ID NO: 1255 - RNA, 21 nt, Gorilla gorilla
uugugcuugaucuaaccaugu

SEQ ID NO: 1256 - RNA, 21 nt, Gorilla gorilla
ugauuguccaaacgcaauucu

SEQ ID NO: 1257 - RNA, 21 nt, Gorilla gorilla
ccacaccgugucugacacuuu

SEQ ID NO: 1258 - RNA, 23 nt, Gorilla gorilla
agcuacauugucugcuggguuuc

SEQ ID NO: 1259 - RNA, 21 nt, Gorilla gorilla
ugucaguuugucaaauacccc

SEQ ID NO: 1260 - RNA, 23 nt, Gorilla gorilla
caagucacuagugguuccguuua

SEQ ID NO: 1261 - RNA, 21 nt, Gorilla gorilla
aucacauugccagggauuucc

SEQ ID NO: 1262 - RNA, 22 nt, Gorilla gorilla
uggcucaguucagcaggaacag

SEQ ID NO: 1263 - RNA, 22 nt, Gorilla gorilla
cauugcacuugucucggucuga

SEQ ID NO: 1264 - RNA, 22 nt, Gorilla gorilla
uucaaguaauccaggauaggcu

SEQ ID NO: 1265 - RNA, 22 nt, Gorilla gorilla
uucacaguggcuaaguuccgcc

SEQ ID NO: 1266 - RNA, 22 nt, Gorilla gorilla
aaggagcucacagucuauugag

SEQ ID NO: 1267 - RNA, 22 nt, Gorilla gorilla
cuagcaccaucugaaaucgguu

SEQ ID NO: 1268 - RNA, 20 nt, Gorilla gorilla
uagcaccauuugaaaucagu

SEQ ID NO: 1269 - RNA, 22 nt, Gorilla gorilla
cuuucagucggauguuugcagc

SEQ ID NO: 1270 - RNA, 22 nt, Gorilla gorilla
uguaaacauccucgacuggaag

SEQ ID NO: 1271 - RNA, 21 nt, Gorilla gorilla
uguaaacauccuacacucagc

SEQ ID NO: 1272 - RNA, 22 nt, Gorilla gorilla
uguaaacauccccgacuggaag

SEQ ID NO: 1273 - RNA, 21 nt, Gorilla gorilla
ggcaagaugcuggcauagcug

SEQ ID NO: 1274 - RNA, 21 nt, Gorilla gorilla
uauugcacauuacuaaguugc

SEQ ID NO: 1275 - RNA, 19 nt, Gorilla gorilla
gugcauuguaguugcauug

SEQ ID NO: 1276 - RNA, 22 nt, Gorilla gorilla
uggcagugucuuagcugguugu

SEQ ID NO: 1277 - RNA, 21 nt, Gorilla gorilla
uggaagacuagugauuuuguu

SEQ ID NO: 1278 - RNA, 23 nt, Gorilla gorilla
ucuuugguuaucuagcuguauga

SEQ ID NO: 1279 - RNA, 22 nt, Gorilla gorilla
uauugcacuugucccggccugu

SEQ ID NO: 1280 - RNA, 22 nt, Gorilla gorilla
aaagugcuguucgugcagguag

SEQ ID NO: 1281 - RNA, 22 nt, Gorilla gorilla
uucaacggguauuuauugagca

SEQ ID NO: 1282 - RNA, 22 nt, Gorilla gorilla
uuuggcacuagcacauuuuugc

SEQ ID NO: 1283 - RNA, 22 nt, Gorilla gorilla
ugagguaguaaguuguauuguu

SEQ ID NO: 1284 - RNA, 22 nt, Gorilla gorilla
aacccguagauccgaucuugug

SEQ ID NO: 1285 - RNA, 20 nt, Glycine max
ugacagaagagagugagcac

SEQ ID NO: 1286 - RNA, 21 nt, Glycine max
ugacagaagagagagagcaca

SEQ ID NO: 1287 - RNA, 21 nt, Glycine max
uugacagaagauagagagcac

SEQ ID NO: 1288 - RNA, 21 nt, Glycine max
uugacagaagauagagagcac

SEQ ID NO: 1289 - RNA, 21 nt, Glycine max
uugacagaagauagagagcac

SEQ ID NO: 1290 - RNA, 21 nt, Glycine max
uuuggauugaagggagcucua

SEQ ID NO: 1291 - RNA, 21 nt, Glycine max
ugccuggcucccuguaugcca

SEQ ID NO: 1292 - RNA, 21 nt, Glycine max
ucggaccaggcuucauucccc

SEQ ID NO: 1293 - RNA, 21 nt, Glycine max
ucggaccaggcuucauucccc

SEQ ID NO: 1294 - RNA, 21 nt, Glycine max
ugaagcugccagcaugaucua

SEQ ID NO: 1295 - RNA, 21 nt, Glycine max
ugaagcugccagcaugaucua

SEQ ID NO: 1296 - RNA, 21 nt, Glycine max
ucgcuuggugcaggucgggaa

SEQ ID NO: 1297 - RNA, 21 nt, Glycine max
cagccaaggaugacuugccgg

SEQ ID NO: 1298 - RNA, 21 nt, Glycine max
agaaucuugaugaugcugcau

SEQ ID NO: 1299 - RNA, 21 nt, Glycine max
agaaucuugaugaugcugcau

SEQ ID NO: 1300 - RNA, 20 nt, Glycine max
uuggacugaagggagcuccc

SEQ ID NO: 1301 - RNA, 20 nt, Glycine max
uuggacugaagggagcuccc

SEQ ID NO: 1302 - RNA, 20 nt, Glycine max
uuggacugaaaggagcuccu

SEQ ID NO: 1303 - RNA, 21 nt, Glycine max
uuccacagcuuucuugaacug

SEQ ID NO: 1304 - RNA, 21 nt, Glycine max
uuccacagcuuucuugaacuu

SEQ ID NO: 1305 - RNA, 21 nt, Glycine max
uguguucucaggucaccccuu

SEQ ID NO: 1306 - RNA, 21 nt, Glycine max
uguguucucaggucaccccuu

SEQ ID NO: 1307 - RNA, 22 nt, Human cytomegalovirus
aagugacggugagauccaggcu

SEQ ID NO: 1308 - RNA, 21 nt, Human cytomegalovirus
ucguccuccccuucuucaccg

SEQ ID NO: 1309 - RNA, 20 nt, Human cytomegalovirus
uaacuagccuucccgugaga

SEQ ID NO: 1310 - RNA, 22 nt, Human cytomegalovirus
ucaccagaaugcuaguuuguag

SEQ ID NO: 1311 - RNA, 22 nt, Human cytomegalovirus
ucguugaagacaccuggaaaga

SEQ ID NO: 1312 - RNA, 20 nt, Human cytomegalovirus
ggggaugggcuggcgcgcgg

SEQ ID NO: 1313 - RNA, 21 nt, Human cytomegalovirus
ugcgucucggccucguccaga

SEQ ID NO: 1314 - RNA, 21 nt, Human cytomegalovirus
aaccgcucaguggcucggacc

SEQ ID NO: 1315 - RNA, 23 nt, Human cytomegalovirus
auccacuuggagagcucccgcgg

SEQ ID NO: 1316 - RNA, 22 nt, Human cytomegalovirus
agcggucuguucagguggauga

SEQ ID NO: 1317 - RNA, 22 nt, Human cytomegalovirus
gauugugcccggaccgugggcg

SEQ ID NO: 1318 - RNA, 22 nt, Human cytomegalovirus
cgacauggacgugcagggggau

SEQ ID NO: 1319 - RNA, 21 nt, Human cytomegalovirus
ugacaagccugacgagagcgu

SEQ ID NO: 1320 - RNA, 22 nt, Human cytomegalovirus
uuaugauaggugugacgauguc

SEQ ID NO: 1321 - RNA, 22 nt, Homo sapiens
ugagguaguagguuguauaguu

SEQ ID NO: 1322 - RNA, 22 nt, Homo sapiens
ugagguaguagguugugugguu

SEQ ID NO: 1323 - RNA, 22 nt, Homo sapiens
ugagguaguagguuguaugguu

SEQ ID NO: 1324 - RNA, 21 nt, Homo sapiens
agagguaguagguugcauagu

SEQ ID NO: 1325 - RNA, 21 nt, Homo sapiens
ugagguaggagguuguauagu

SEQ ID NO: 1326 - RNA, 22 nt, Homo sapiens
ugagguaguagauuguauaguu

SEQ ID NO: 1327 - RNA, 21 nt, Homo sapiens
ugagguaguaguuuguacagu

SEQ ID NO: 1328 - RNA, 21 nt, Homo sapiens
ugagguaguaguuugugcugu

SEQ ID NO: 1329 - RNA, 21 nt, Homo sapiens
uggaauguaaagaaguaugua

SEQ ID NO: 1330 - RNA, 22 nt, Homo sapiens
aacccguagauccgaacuugug

SEQ ID NO: 1331 - RNA, 22 nt, Homo sapiens
uacaguacugugauaacugaag

SEQ ID NO: 1332 - RNA, 23 nt, Homo sapiens
agcagcauuguacagggcuauga

SEQ ID NO: 1333 - RNA, 20 nt, Homo sapiens
ucaaaugcucagacuccugu

SEQ ID NO: 1334 - RNA, 24 nt, Homo sapiens
aaaagugcuuacagugcagguagc

SEQ ID NO: 1335 - RNA, 21 nt, Homo sapiens
uaaagugcugacagugcagau

SEQ ID NO: 1336 - RNA, 23 nt, Homo sapiens
agcagcauuguacagggcuauca

SEQ ID NO: 1337 - RNA, 23 nt, Homo sapiens
uacccuguagauccgaauuugug

SEQ ID NO: 1338 - RNA, 22 nt, Homo sapiens
uacccuguagaaccgaauuugu

SEQ ID NO: 1339 - RNA, 23 nt, Homo sapiens
uggagugugacaaugguguuugu

SEQ ID NO: 1340 - RNA, 22 nt, Homo sapiens
uuaaggcacgcggugaaugcca

SEQ ID NO: 1341 - RNA, 23 nt, Homo sapiens
ucccugagacccuuuaaccugug

SEQ ID NO: 1342 - RNA, 22 nt, Homo sapiens
ucccugagacccuaacuuguga

SEQ ID NO: 1343 - RNA, 21 nt, Homo sapiens
ucguaccgugaguaauaaugc

SEQ ID NO: 1344 - RNA, 21 nt, Homo sapiens
cauuauuacuuuugguacgcg

SEQ ID NO: 1345 - RNA, 22 nt, Homo sapiens
ucggauccgucugagcuuggcu

SEQ ID NO: 1346 - RNA, 22 nt, Homo sapiens
ucacagugaaccggucucuuuu

SEQ ID NO: 1347 - RNA, 22 nt, Homo sapiens
ucacagugaaccggucucuuuc

SEQ ID NO: 1348 - RNA, 21 nt, Homo sapiens
cuuuuugcggucugggcuugc

SEQ ID NO: 1349 - RNA, 22 nt, Homo sapiens
cagugcaauguuaaaagggcau

SEQ ID NO: 1350 - RNA, 22 nt, Homo sapiens
cagugcaaugaugaaagggcau

SEQ ID NO: 1351 - RNA, 22 nt, Homo sapiens
uaacagucuacagccauggucg

SEQ ID NO: 1352 - RNA, 22 nt, Homo sapiens
uugguccccuucaaccagcugu

SEQ ID NO: 1353 - RNA, 21 nt, Homo sapiens
uugguccccuucaaccagcua

SEQ ID NO: 1354 - RNA, 21 nt, Homo sapiens
ugugacugguugaccagaggg

SEQ ID NO: 1355 - RNA, 23 nt, Homo sapiens
uauggcuuuuuauuccuauguga

SEQ ID NO: 1356 - RNA, 22 nt, Homo sapiens
uauggcuuuucauuccuaugug

SEQ ID NO: 1357 - RNA, 23 nt, Homo sapiens
acuccauuuguuuugaugaugga

SEQ ID NO: 1358 - RNA, 22 nt, Homo sapiens
uauugcuuaagaauacgcguag

SEQ ID NO: 1359 - RNA, 17 nt, Homo sapiens
agcugguguugugaauc

SEQ ID NO: 1360 - RNA, 18 nt, Homo sapiens
ucuacagugcacgugucu

SEQ ID NO: 1361 - RNA, 21 nt, Homo sapiens
agugguuuuacccuaugguag

SEQ ID NO: 1362 - RNA, 22 nt, Homo sapiens
uaacacugucugguaaagaugg

SEQ ID NO: 1363 - RNA, 23 nt, Homo sapiens
uguaguguuuccuacuuuaugga

SEQ ID NO: 1364 - RNA, 20 nt, Homo sapiens
cauaaaguagaaagcacuac

SEQ ID NO: 1365 - RNA, 22 nt, Homo sapiens
ugagaugaagcacuguagcuca

SEQ ID NO: 1366 - RNA, 22 nt, Homo sapiens
uacaguauagaugauguacuag

SEQ ID NO: 1367 - RNA, 24 nt, Homo sapiens
guccaguuuucccaggaaucccuu

SEQ ID NO: 1368 - RNA, 22 nt, Homo sapiens
ugagaacugaauuccauggguu

SEQ ID NO: 1369 - RNA, 22 nt, Homo sapiens
ugagaacugaauuccauaggcu

SEQ ID NO: 1370 - RNA, 20 nt, Homo sapiens
guguguggaaaugcuucugc

SEQ ID NO: 1371 - RNA, 22 nt, Homo sapiens
ucagugcacuacagaacuuugu

SEQ ID NO: 1372 - RNA, 22 nt, Homo sapiens
ucagugcaucacagaacuuugu

SEQ ID NO: 1373 - RNA, 22 nt, Homo sapiens
ucuggcuccgugucuucacucc

SEQ ID NO: 1374 - RNA, 22 nt, Homo sapiens
ucucccaacccuuguaccagug

SEQ ID NO: 1375 - RNA, 22 nt, Homo sapiens
acuagacugaagcuccuugagg

SEQ ID NO: 1376 - RNA, 22 nt, Homo sapiens
ucagugcaugacagaacuuggg

SEQ ID NO: 1377 - RNA, 20 nt, Homo sapiens
uugcauagucacaaaaguga

SEQ ID NO: 1378 - RNA, 22 nt, Homo sapiens
uagguuauccguguugccuucg

SEQ ID NO: 1379 - RNA, 22 nt, Homo sapiens
aaucauacacgguugaccuauu

SEQ ID NO: 1380 - RNA, 22 nt, Homo sapiens
uuaaugcuaaucgugauagggg

SEQ ID NO: 1381 - RNA, 22 nt, Homo sapiens
uagcagcacauaaugguuugug

SEQ ID NO: 1382 - RNA, 22 nt, Homo sapiens
uagcagcacaucaugguuuaca

SEQ ID NO: 1383 - RNA, 22 nt, Homo sapiens
uagcagcacguaaauauuggcg

SEQ ID NO: 1384 - RNA, 20 nt, Homo sapiens
acugcagugaaggcacuugu

SEQ ID NO: 1385 - RNA, 24 nt, Homo sapiens
caaagugcuuacagugcagguagu

SEQ ID NO: 1386 - RNA, 23 nt, Homo sapiens
aacauucaacgcugucggugagu

SEQ ID NO: 1387 - RNA, 22 nt, Homo sapiens
accaucgaccguugauuguacc

SEQ ID NO: 1388 - RNA, 22 nt, Homo sapiens
aacauucauugcugucgguggg

SEQ ID NO: 1389 - RNA, 22 nt, Homo sapiens
aacauucaaccugucggugagu

SEQ ID NO: 1390 - RNA, 24 nt, Homo sapiens
aacauucauuguugucgguggguu

SEQ ID NO: 1391 - RNA, 22 nt, Homo sapiens
uuuggcaaugguagaacucaca

SEQ ID NO: 1392 - RNA, 21 nt, Homo sapiens
ugguucuagacuugccaacua

SEQ ID NO: 1393 - RNA, 23 nt, Homo sapiens
uauggcacugguagaauucacug

SEQ ID NO: 1394 - RNA, 22 nt, Homo sapiens
uggacggagaacugauaagggu

SEQ ID NO: 1395 - RNA, 18 nt, Homo sapiens
uggagagaaaggcaguuc

SEQ ID NO: 1396 - RNA, 23 nt, Homo sapiens
caaagaauucuccuuuugggcuu

SEQ ID NO: 1397 - RNA, 21 nt, Homo sapiens
ucgugucuuguguugcagccg

SEQ ID NO: 1398 - RNA, 22 nt, Homo sapiens
caucccuugcaugguggagggu

SEQ ID NO: 1399 - RNA, 23 nt, Homo sapiens
gugccuacugagcugauaucagu

SEQ ID NO: 1400 - RNA, 22 nt, Homo sapiens
uaaggugcaucuagugcagaua

SEQ ID NO: 1401 - RNA, 21 nt, Homo sapiens
acugcccuaagugcuccuucu

SEQ ID NO: 1402 - RNA, 22 nt, Homo sapiens
uaaggugcaucuagugcaguua

SEQ ID NO: 1403 - RNA, 22 nt, Homo sapiens
ugauauguuugauauauuaggu

SEQ ID NO: 1404 - RNA, 22 nt, Homo sapiens
caacggaaucccaaaagcagcu

SEQ ID NO: 1405 - RNA, 22 nt, Homo sapiens
gcugcgcuuggauuucgucccc

SEQ ID NO: 1406 - RNA, 21 nt, Homo sapiens
cugaccuaugaauugacagcc

SEQ ID NO: 1407 - RNA, 21 nt, Homo sapiens
aacuggccuacaaagucccag

SEQ ID NO: 1408 - RNA, 24 nt, Homo sapiens
aacuggcccucaaagucccgcuuu

SEQ ID NO: 1409 - RNA, 22 nt, Homo sapiens
uguaacagcaacuccaugugga

SEQ ID NO: 1410 - RNA, 21 nt, Homo sapiens
uagcagcacagaaauauuggc

SEQ ID NO: 1411 - RNA, 21 nt, Homo sapiens
uagguaguuucauguuguugg

SEQ ID NO: 1412 - RNA, 21 nt, Homo sapiens
uagguaguuuccuguuguugg

SEQ ID NO: 1413 - RNA, 22 nt, Homo sapiens
uucaccaccuucuccacccagc

SEQ ID NO: 1414 - RNA, 19 nt, Homo sapiens
gguccagaggggagauagg

SEQ ID NO: 1415 - RNA, 23 nt, Homo sapiens
cccaguguucagacuaccuguuc

SEQ ID NO: 1416 - RNA, 22 nt, Homo sapiens
uacaguagucugcacauugguu

SEQ ID NO: 1417 - RNA, 23 nt, Homo sapiens
cccaguguuuagacuaucuguuc

SEQ ID NO: 1418 - RNA, 23 nt, Homo sapiens
ugugcaaaucuaugcaaaacuga

SEQ ID NO: 1419 - RNA, 23 nt, Homo sapiens
ugugcaaauccaugcaaaacuga

SEQ ID NO: 1420 - RNA, 22 nt, Homo sapiens
uaacacugucugguaacgaugu

SEQ ID NO: 1421 - RNA, 22 nt, Homo sapiens
caucuuaccggacagugcugga

SEQ ID NO: 1422 - RNA, 23 nt, Homo sapiens
uaauacugccugguaaugaugac

SEQ ID NO: 1423 - RNA, 22 nt, Homo sapiens
uaauacugccggguaaugaugg

SEQ ID NO: 1424 - RNA, 22 nt, Homo sapiens
agagguauagggcaugggaaaa

SEQ ID NO: 1425 - RNA, 22 nt, Homo sapiens
uuuccuaugcauauacuucuuu

SEQ ID NO: 1426 - RNA, 22 nt, Homo sapiens
gugaaauguuuaggaccacuag

SEQ ID NO: 1427 - RNA, 22 nt, Homo sapiens
uucccuuugucauccuaugccu

SEQ ID NO: 1428 - RNA, 22 nt, Homo sapiens
uccuucauuccaccggagucug

SEQ ID NO: 1429 - RNA, 22 nt, Homo sapiens
uggaauguaaggaagugugugg

SEQ ID NO: 1430 - RNA, 22 nt, Homo sapiens
auaagacgagcaaaaagcuugu

SEQ ID NO: 1431 - RNA, 23 nt, Homo sapiens
uaaagugcuuauagugcagguag

SEQ ID NO: 1432 - RNA, 23 nt, Homo sapiens
caaagugcucauagugcagguag

SEQ ID NO: 1433 - RNA, 22 nt, Homo sapiens
uagcuuaucagacugauguuga

SEQ ID NO: 1434 - RNA, 22 nt, Homo sapiens
cugugcgugugacagcggcuga

SEQ ID NO: 1435 - RNA, 22 nt, Homo sapiens
uucccuuugucauccuucgccu

SEQ ID NO: 1436 - RNA, 21 nt, Homo sapiens
uaacagucuccagucacggcc

SEQ ID NO: 1437 - RNA, 21 nt, Homo sapiens
acagcaggcacagacaggcag

SEQ ID NO: 1438 - RNA, 21 nt, Homo sapiens
augaccuaugaauugacagac

SEQ ID NO: 1439 - RNA, 21 nt, Homo sapiens
uaaucucagcuggcaacugug

SEQ ID NO: 1440 - RNA, 24 nt, Homo sapiens
uacugcaucaggaacugauuggau

SEQ ID NO: 1441 - RNA, 21 nt, Homo sapiens
uugugcuugaucuaaccaugu

SEQ ID NO: 1442 - RNA, 21 nt, Homo sapiens
ugauuguccaaacgcaauucu

SEQ ID NO: 1443 - RNA, 22 nt, Homo sapiens
aagcugccaguugaagaacugu

SEQ ID NO: 1444 - RNA, 21 nt, Homo sapiens
ccacaccguaucugacacuuu

SEQ ID NO: 1445 - RNA, 23 nt, Homo sapiens
agcuacauugucugcuggguuuc

SEQ ID NO: 1446 - RNA, 24 nt, Homo sapiens
agcuacaucuggcuacugggucuc

SEQ ID NO: 1447 - RNA, 21 nt, Homo sapiens
ugucaguuugucaaauacccc

SEQ ID NO: 1448 - RNA, 23 nt, Homo sapiens
caagucacuagugguuccguuua

SEQ ID NO: 1449 - RNA, 21 nt, Homo sapiens
aucacauugccagggauuucc

SEQ ID NO: 1450 - RNA, 21 nt, Homo sapiens
aucacauugccagggauuacc

SEQ ID NO: 1451 - RNA, 22 nt, Homo sapiens
uggcucaguucagcaggaacag

SEQ ID NO: 1452 - RNA, 22 nt, Homo sapiens
cauugcacuugucucggucuga

SEQ ID NO: 1453 - RNA, 21 nt, Homo sapiens
uucaaguaauccaggauaggc

SEQ ID NO: 1454 - RNA, 22 nt, Homo sapiens
uucaaguaauucaggauagguu

SEQ ID NO: 1455 - RNA, 21 nt, Homo sapiens
uucacaguggcuaaguuccgc

SEQ ID NO: 1456 - RNA, 21 nt, Homo sapiens
uucacaguggcuaaguucugc

SEQ ID NO: 1457 - RNA, 22 nt, Homo sapiens
aaggagcucacagucuauugag

SEQ ID NO: 1458 - RNA, 21 nt, Homo sapiens
agggcccccccucaauccugu

SEQ ID NO: 1459 - RNA, 22 nt, Homo sapiens
uaugugggaugguaaaccgcuu

SEQ ID NO: 1460 - RNA, 22 nt, Homo sapiens
ugguuuaccgucccacauacau

SEQ ID NO: 1461 - RNA, 21 nt, Homo sapiens
uagcaccaucugaaaucgguu

SEQ ID NO: 1462 - RNA, 23 nt, Homo sapiens
uagcaccauuugaaaucaguguu

SEQ ID NO: 1463 - RNA, 20 nt, Homo sapiens
uagcaccauuugaaaucggu

SEQ ID NO: 1464 - RNA, 23 nt, Homo sapiens
cagugcaauaguauugucaaagc

SEQ ID NO: 1465 - RNA, 23 nt, Homo sapiens
uaagugcuuccauguuuugguga

SEQ ID NO: 1466 - RNA, 22 nt, Homo sapiens
uaaacguggauguacuugcuuu

SEQ ID NO: 1467 - RNA, 23 nt, Homo sapiens
uaagugcuuccauguuuuaguag

SEQ ID NO: 1468 - RNA, 23 nt, Homo sapiens
acuuuaacauggaagugcuuucu

SEQ ID NO: 1469 - RNA, 23 nt, Homo sapiens
uaagugcuuccauguuucagugg

SEQ ID NO: 1470 - RNA, 22 nt, Homo sapiens
uuuaacauggggguaccugcug

SEQ ID NO: 1471 - RNA, 23 nt, Homo sapiens
uaagugcuuccauguuugagugu

SEQ ID NO: 1472 - RNA, 22 nt, Homo sapiens
cuuucagucggauguuugcagc

SEQ ID NO: 1473 - RNA, 22 nt, Homo sapiens
uguaaacauccucgacuggaag

SEQ ID NO: 1474 - RNA, 22 nt, Homo sapiens
uguaaacauccuacacucagcu

SEQ ID NO: 1475 - RNA, 23 nt, Homo sapiens
uguaaacauccuacacucucagc

SEQ ID NO: 1476 - RNA, 22 nt, Homo sapiens
uguaaacauccccgacuggaag

SEQ ID NO: 1477 - RNA, 22 nt, Homo sapiens
cuuucagucggauguuuacagc

SEQ ID NO: 1478 - RNA, 20 nt, Homo sapiens
uguaaacauccuugacugga

SEQ ID NO: 1479 - RNA, 21 nt, Homo sapiens
ggcaagaugcuggcauagcug

SEQ ID NO: 1480 - RNA, 21 nt, Homo sapiens
uauugcacauuacuaaguugc

SEQ ID NO: 1481 - RNA, 23 nt, Homo sapiens
aaaagcuggguugagagggcgaa

SEQ ID NO: 1482 - RNA, 22 nt, Homo sapiens
gcacauuacacggucgaccucu

SEQ ID NO: 1483 - RNA, 22 nt, Homo sapiens
ccacugccccaggugcugcugg

SEQ ID NO: 1484 - RNA, 23 nt, Homo sapiens
cgcauccccuagggcauuggugu

SEQ ID NO: 1485 - RNA, 23 nt, Homo sapiens
ccuaguagguguccaguaagugu

SEQ ID NO: 1486 - RNA, 20 nt, Homo sapiens
ccucugggcccuuccuccag

SEQ ID NO: 1487 - RNA, 22 nt, Homo sapiens
cuggcccucucugcccuuccgu

SEQ ID NO: 1488 - RNA, 22 nt, Homo sapiens
aacacaccugguuaaccucuuu

SEQ ID NO: 1489 - RNA, 19 nt, Homo sapiens
gugcauuguaguugcauug

SEQ ID NO: 1490 - RNA, 23 nt, Homo sapiens
gcaaagcacacggccugcagaga

SEQ ID NO: 1491 - RNA, 21 nt, Homo sapiens
gccccugggccuauccuagaa

SEQ ID NO: 1492 - RNA, 23 nt, Homo sapiens
ucaagagcaauaacgaaaaaugu

SEQ ID NO: 1493 - RNA, 23 nt, Homo sapiens
uccagcuccuauaugaugccuuu

SEQ ID NO: 1494 - RNA, 23 nt, Homo sapiens
uccagcaucagugauuuuguuga

SEQ ID NO: 1495 - RNA, 21 nt, Homo sapiens
ucccuguccuccaggagcuca

SEQ ID NO: 1496 - RNA, 21 nt, Homo sapiens
gugcauugcuguugcauugca

SEQ ID NO: 1497 - RNA, 23 nt, Homo sapiens
uccgucucaguuacuuuauagcc

SEQ ID NO: 1498 - RNA, 24 nt, Homo sapiens
ucucacacagaaaucgcacccguc

SEQ ID NO: 1499 - RNA, 21 nt, Homo sapiens
ugcugacuccuaguccagggc

SEQ ID NO: 1500 - RNA, 23 nt, Homo sapiens
ugucugcccgcaugccugccucu

SEQ ID NO: 1501 - RNA, 23 nt, Homo sapiens
uggcagugucuuagcugguuguu

SEQ ID NO: 1502 - RNA, 23 nt, Homo sapiens
uaggcagugucauuagcugauug

SEQ ID NO: 1503 - RNA, 23 nt, Homo sapiens
aggcaguguaguuagcugauugc

SEQ ID NO: 1504 - RNA, 22 nt, Homo sapiens
uuaucagaaucuccagggguac

SEQ ID NO: 1505 - RNA, 24 nt, Homo sapiens
aauccuuggaaccuaggugugagu

SEQ ID NO: 1506 - RNA, 22 nt, Homo sapiens
aauugcacgguauccaucugua

SEQ ID NO: 1507 - RNA, 22 nt, Homo sapiens
cggguggaucacgaugcaauuu

SEQ ID NO: 1508 - RNA, 22 nt, Homo sapiens
uaaugccccuaaaaauccuuau

SEQ ID NO: 1509 - RNA, 22 nt, Homo sapiens
aauugcacuuuagcaaugguga

SEQ ID NO: 1510 - RNA, 22 nt, Homo sapiens
acauagaggaaauuccacguuu

SEQ ID NO: 1511 - RNA, 21 nt, Homo sapiens
aauaauacaugguugaucuuu

SEQ ID NO: 1512 - RNA, 22 nt, Homo sapiens
agaucgaccguguuauauucgc

SEQ ID NO: 1513 - RNA, 21 nt, Homo sapiens
gccugcugggguggaaccugg

SEQ ID NO: 1514 - RNA, 21 nt, Homo sapiens
gugccgccaucuuuugagugu

SEQ ID NO: 1515 - RNA, 23 nt, Homo sapiens
aaagugcugcgacauuugagcgu

SEQ ID NO: 1516 - RNA, 23 nt, Homo sapiens
gaagugcuucgauuuuggggugu

SEQ ID NO: 1517 - RNA, 22 nt, Homo sapiens
acucaaaaugggggcgcuuucc

SEQ ID NO: 1518 - RNA, 22 nt, Homo sapiens
uuauaauacaaccugauaagug

SEQ ID NO: 1519 - RNA, 22 nt, Homo sapiens
uuuguucguucggcucgcguga

SEQ ID NO: 1520 - RNA, 21 nt, Homo sapiens
aucauagaggaaaauccacgu

SEQ ID NO: 1521 - RNA, 21 nt, Homo sapiens
gguagauucuccuucuaugag

SEQ ID NO: 1522 - RNA, 22 nt, Homo sapiens
aucauagaggaaaauccauguu

SEQ ID NO: 1523 - RNA, 22 nt, Homo sapiens
aucacacaaaggcaacuuuugu

SEQ ID NO: 1524 - RNA, 22 nt, Homo sapiens
cuccugacuccagguccugugu

SEQ ID NO: 1525 - RNA, 19 nt, Homo sapiens
ugguagacuauggaacgua

SEQ ID NO: 1526 - RNA, 22 nt, Homo sapiens
uauguaauaugguccacaucuu

SEQ ID NO: 1527 - RNA, 22 nt, Homo sapiens
ugguugaccauagaacaugcgc

SEQ ID NO: 1528 - RNA, 22 nt, Homo sapiens
uauacaagggcaagcucucugu

SEQ ID NO: 1529 - RNA, 22 nt, Homo sapiens
gaaguuguucgugguggauucg

SEQ ID NO: 1530 - RNA, 22 nt, Homo sapiens
agaucagaaggugauuguggcu

SEQ ID NO: 1531 - RNA, 20 nt, Homo sapiens
auuccuagaaauuguucaua

SEQ ID NO: 1532 - RNA, 23 nt, Homo sapiens
cgaauguugcucggugaaccccu

SEQ ID NO: 1533 - RNA, 22 nt, Homo sapiens
agguuacccgagcaacuuugca

SEQ ID NO: 1534 - RNA, 21 nt, Homo sapiens
aauauaacacagauggccugu

SEQ ID NO: 1535 - RNA, 21 nt, Homo sapiens
uaguagaccguauagcguacg

SEQ ID NO: 1536 - RNA, 23 nt, Homo sapiens
acuucaccugguccacuagccgu

SEQ ID NO: 1537 - RNA, 23 nt, Homo sapiens
aucaacagacauuaauugggcgc

SEQ ID NO: 1538 - RNA, 22 nt, Homo sapiens
cuggacuuagggucagaaggcc

SEQ ID NO: 1539 - RNA, 22 nt, Homo sapiens
cuggacuuggagucagaaggcc

SEQ ID NO: 1540 - RNA, 22 nt, Homo sapiens
agcucggucugaggccccucag

SEQ ID NO: 1541 - RNA, 22 nt, Homo sapiens
cagcagcaauucauguuuugaa

SEQ ID NO: 1542 - RNA, 21 nt, Homo sapiens
aucgggaaugucguguccgcc

SEQ ID NO: 1543 - RNA, 23 nt, Homo sapiens
aaugacacgaucacucccguuga

SEQ ID NO: 1544 - RNA, 22 nt, Homo sapiens
uaauacugucugguaaaaccgu

SEQ ID NO: 1545 - RNA, 21 nt, Homo sapiens
ugucuugcaggccgucaugca

SEQ ID NO: 1546 - RNA, 23 nt, Homo sapiens
ucuuggaguaggucauugggugg

SEQ ID NO: 1547 - RNA, 21 nt, Homo sapiens
cuggauggcuccuccaugucu

SEQ ID NO: 1548 - RNA, 22 nt, Homo sapiens
aucaugaugggcuccucggugu

SEQ ID NO: 1549 - RNA, 22 nt, Homo sapiens
uugcauauguaggaugucccau

SEQ ID NO: 1550 - RNA, 22 nt, Homo sapiens
uggcaguguauuguuagcuggu

SEQ ID NO: 1551 - RNA, 22 nt, Homo sapiens
aggcaguguauuguuagcuggc

SEQ ID NO: 1552 - RNA, 22 nt, Homo sapiens
uuuuugcgauguguuccuaaua

SEQ ID NO: 1553 - RNA, 23 nt, Homo sapiens
aaaccguuaccauuacugaguuu

SEQ ID NO: 1554 - RNA, 22 nt, Homo sapiens
uguuugcagaggaaacugagac

SEQ ID NO: 1555 - RNA, 21 nt, Homo sapiens
ucagucucaucugcaaagaag

SEQ ID NO: 1556 - RNA, 22 nt, Homo sapiens
gagguuguccguggugaguucg

SEQ ID NO: 1557 - RNA, 25 nt, Homo sapiens
uagugcaauauugcuuauaggguuu

SEQ ID NO: 1558 - RNA, 22 nt, Homo sapiens
acccuaucaauauugucucugc

SEQ ID NO: 1559 - RNA, 22 nt, Homo sapiens
uaugugccuuuggacuacaucg

SEQ ID NO: 1560 - RNA, 23 nt, Homo sapiens
ucacuccucuccucccgucuucu

SEQ ID NO: 1561 - RNA, 22 nt, Homo sapiens
ucaggcucaguccccucccgau

SEQ ID NO: 1562 - RNA, 22 nt, Homo sapiens
gucauacacggcucuccucucu

SEQ ID NO: 1563 - RNA, 22 nt, Homo sapiens
agaggcuggccgugaugaauuc

SEQ ID NO: 1564 - RNA, 22 nt, Homo sapiens
uccuguacugagcugccccgag

SEQ ID NO: 1565 - RNA, 22 nt, Homo sapiens
aaucauacagggacauccaguu

SEQ ID NO: 1566 - RNA, 22 nt, Homo sapiens
aaucguacagggucauccacuu

SEQ ID NO: 1567 - RNA, 21 nt, Homo sapiens
cccagauaauggcacucucaa

SEQ ID NO: 1568 - RNA, 23 nt, Homo sapiens
agugacaucacauauacggcagc

SEQ ID NO: 1569 - RNA, 22 nt, Homo sapiens
caaccuggaggacuccaugcug

SEQ ID NO: 1570 - RNA, 23 nt, Homo sapiens
aguggggaacccuuccaugagga

SEQ ID NO: 1571 - RNA, 23 nt, Homo sapiens
aggaccugcgggacaagauucuu

SEQ ID NO: 1572 - RNA, 21 nt, Homo sapiens
ugaaggucuacugugugccag

SEQ ID NO: 1573 - RNA, 22 nt, Homo sapiens
uuguacaugguaggcuuucauu

SEQ ID NO: 1574 - RNA, 24 nt, Homo sapiens
ugaaacauacacgggaaaccucuu

SEQ ID NO: 1575 - RNA, 23 nt, Homo sapiens
aaacaaacauggugcacuucuuu

SEQ ID NO: 1576 - RNA, 17 nt, Homo sapiens
auuacauggccaaucuc

SEQ ID NO: 1577 - RNA, 21 nt, Homo sapiens
cagcagcacacugugguuugu

SEQ ID NO: 1578 - RNA, 23 nt, Homo sapiens
uuucaagccagggggcguuuuuc

SEQ ID NO: 1579 - RNA, 23 nt, Homo sapiens
uuaagacuugcagugauguuuaa

SEQ ID NO: 1580 - RNA, 22 nt, Homo sapiens
augcaccugggcaaggauucug

SEQ ID NO: 1581 - RNA, 22 nt, Homo sapiens
aauccuuugucccugggugaga

SEQ ID NO: 1582 - RNA, 21 nt, Homo sapiens
auccuugcuaucugggugcua

SEQ ID NO: 1583 - RNA, 23 nt, Homo sapiens
uagcagcgggaacaguucugcag

SEQ ID NO: 1584 - RNA, 21 nt, Homo sapiens
agacccuggucugcacucuau

SEQ ID NO: 1585 - RNA, 22 nt, Homo sapiens
gucaacacuugcugguuuccuc

SEQ ID NO: 1586 - RNA, 21 nt, Homo sapiens
uaaggcacccuucugaguaga

SEQ ID NO: 1587 - RNA, 21 nt, Homo sapiens
uuuugcaccuuuuggagugaa

SEQ ID NO: 1588 - RNA, 23 nt, Homo sapiens
ugauuguagccuuuuggaguaga

SEQ ID NO: 1589 - RNA, 23 nt, Homo sapiens
ugauugguacgucuguggguaga

SEQ ID NO: 1590 - RNA, 23 nt, Homo sapiens
uacucaggagaguggcaaucaca

SEQ ID NO: 1591 - RNA, 21 nt, Homo sapiens
gugucuuuugcucugcaguca

SEQ ID NO: 1592 - RNA, 22 nt, Homo sapiens
aagugcugucauagcugagguc

SEQ ID NO: 1593 - RNA, 23 nt, Homo sapiens
cacucagccuugagggcacuuuc

SEQ ID NO: 1594 - RNA, 22 nt, Homo sapiens
uucacagggaggugucauuuau

SEQ ID NO: 1595 - RNA, 20 nt, Homo sapiens
auugacacuucugugaguag

SEQ ID NO: 1596 - RNA, 21 nt, Homo sapiens
gagugccuucuuuuggagcgu

SEQ ID NO: 1597 - RNA, 24 nt, Homo sapiens
uucuccaaaagaaagcacuuucug

SEQ ID NO: 1598 - RNA, 18 nt, Homo sapiens
ugcuuccuuucagagggu

SEQ ID NO: 1599 - RNA, 23 nt, Homo sapiens
caucuggagguaagaagcacuuu

SEQ ID NO: 1600 - RNA, 22 nt, Homo sapiens
ccucuagauggaagcacugucu

SEQ ID NO: 1601 - RNA, 23 nt, Homo sapiens
aucgugcaucccuuuagaguguu

SEQ ID NO: 1602 - RNA, 22 nt, Homo sapiens
ucgugcaucccuuuagaguguu

SEQ ID NO: 1603 - RNA, 22 nt, Homo sapiens
aucgugcauccuuuuagagugu

SEQ ID NO: 1604 - RNA, 21 nt, Homo sapiens
aaagcgcuucccuuugcugga

SEQ ID NO: 1605 - RNA, 22 nt, Homo sapiens
caaagcgcuccccuuuagaggu

SEQ ID NO: 1606 - RNA, 22 nt, Homo sapiens
caaagcgcuucucuuuagagug

SEQ ID NO: 1607 - RNA, 23 nt, Homo sapiens
ucucuggagggaagcacuuucug

SEQ ID NO: 1608 - RNA, 21 nt, Homo sapiens
caaagcgcuucccuuuggagc

SEQ ID NO: 1609 - RNA, 22 nt, Homo sapiens
aaagcgcuucccuucagagugu

SEQ ID NO: 1610 - RNA, 21 nt, Homo sapiens
aaagcgcuucucuuuagagga

SEQ ID NO: 1611 - RNA, 23 nt, Homo sapiens
cucuagagggaagcacuuucucu

SEQ ID NO: 1612 - RNA, 25 nt, Homo sapiens
aaagugcauccuuuuagaguguuac

SEQ ID NO: 1613 - RNA, 23 nt, Homo sapiens
aaagugcauccuuuuagagguuu

SEQ ID NO: 1614 - RNA, 22 nt, Homo sapiens
aaagugcaucuuuuuagaggau

SEQ ID NO: 1615 - RNA, 23 nt, Homo sapiens
caaagugccucccuuuagagugu

SEQ ID NO: 1616 - RNA, 22 nt, Homo sapiens
aaagugccuccuuuuagagugu

SEQ ID NO: 1617 - RNA, 22 nt, Homo sapiens
uucuccaaaagggagcacuuuc

SEQ ID NO: 1618 - RNA, 22 nt, Homo sapiens
aaagugcuucccuuuggacugu

SEQ ID NO: 1619 - RNA, 21 nt, Homo sapiens
cuccagagggaaguacuuucu

SEQ ID NO: 1620 - RNA, 21 nt, Homo sapiens
aaagugcuuccuuuuagaggg

SEQ ID NO: 1621 - RNA, 23 nt, Homo sapiens
aaagugcuuccuuuuagaggguu

SEQ ID NO: 1622 - RNA, 23 nt, Homo sapiens
aaagugcuucucuuugguggguu

SEQ ID NO: 1623 - RNA, 23 nt, Homo sapiens
ucuacaaagggaagcccuuucug

SEQ ID NO: 1624 - RNA, 21 nt, Homo sapiens
aaagugcuuccuuuuugaggg

SEQ ID NO: 1625 - RNA, 22 nt, Homo sapiens
aagugcuuccuuuuagaggguu

SEQ ID NO: 1626 - RNA, 24 nt, Homo sapiens
acaaagugcuucccuuuagagugu

SEQ ID NO: 1627 - RNA, 22 nt, Homo sapiens
acaaagugcuucccuuuagagu

SEQ ID NO: 1628 - RNA, 22 nt, Homo sapiens
aacgcacuucccuuuagagugu

SEQ ID NO: 1629 - RNA, 23 nt, Homo sapiens
aaaaugguucccuuuagaguguu

SEQ ID NO: 1630 - RNA, 21 nt, Homo sapiens
aacgcgcuucccuauagaggg

SEQ ID NO: 1631 - RNA, 21 nt, Homo sapiens
gaaggcgcuucccuuuggagu

SEQ ID NO: 1632 - RNA, 22 nt, Homo sapiens
cuacaaagggaagcacuuucuc

SEQ ID NO: 1633 - RNA, 21 nt, Homo sapiens
cuccagagggaugcacuuucu

SEQ ID NO: 1634 - RNA, 21 nt, Homo sapiens
gaaggcgcuucccuuuagagc

SEQ ID NO: 1635 - RNA, 21 nt, Homo sapiens
cucuagagggaagcacuuucu

SEQ ID NO: 1636 - RNA, 24 nt, Homo sapiens
cucuugagggaagcacuuucuguu

SEQ ID NO: 1637 - RNA, 21 nt, Homo sapiens
aaagugcuuccuuuuagaggc

SEQ ID NO: 1638 - RNA, 24 nt, Homo sapiens
cucuagagggaagcgcuuucuguu

SEQ ID NO: 1639 - RNA, 21 nt, Homo sapiens
cugcaaagggaagcccuuucu

SEQ ID NO: 1640 - RNA, 22 nt, Homo sapiens
caugccuugaguguaggaccgu

SEQ ID NO: 1641 - RNA, 22 nt, Homo sapiens
ggagaaauuauccuuggugugu

SEQ ID NO: 1642 - RNA, 22 nt, Homo sapiens
ugugacagauugauaacugaaa

SEQ ID NO: 1643 - RNA, 22 nt, Homo sapiens
ucggggaucaucaugucacgag

SEQ ID NO: 1644 - RNA, 20 nt, Homo sapiens
auucugcauuuuuagcaagu

SEQ ID NO: 1645 - RNA, 22 nt, Homo sapiens
aucagcaaacauuuauugugug

SEQ ID NO: 1646 - RNA, 22 nt, Homo sapiens
caaaacuggcaauuacuuuugc

SEQ ID NO: 1647 - RNA, 22 nt, Homo sapiens
caagaaccucaguugcuuuugu

SEQ ID NO: 1648 - RNA, 22 nt, Homo sapiens
caaaaaucucaauuacuuuugc

SEQ ID NO: 1649 - RNA, 22 nt, Homo sapiens
caaaaaccacaguuucuuuugc

SEQ ID NO: 1650 - RNA, 21 nt, Homo sapiens
ugacaacuauggaugagcucu

SEQ ID NO: 1651 - RNA, 22 nt, Homo sapiens
ugucuuacucccucaggcacau

SEQ ID NO: 1652 - RNA, 21 nt, Homo sapiens
gcgacccacucuugguuucca

SEQ ID NO: 1653 - RNA, 21 nt, Homo sapiens
gcgacccauacuugguuucag

SEQ ID NO: 1654 - RNA, 21 nt, Homo sapiens
aacaggugacugguuagacaa

SEQ ID NO: 1655 - RNA, 21 nt, Homo sapiens
aaaacggugagauuuuguuuu

SEQ ID NO: 1656 - RNA, 21 nt, Homo sapiens
gcuaguccugacucagccagu

SEQ ID NO: 1657 - RNA, 21 nt, Homo sapiens
aggguaagcugaaccucugau

SEQ ID NO: 1658 - RNA, 20 nt, Homo sapiens
gaugagcucauuguaauaug

SEQ ID NO: 1659 - RNA, 23 nt, Homo sapiens
guuugcacgggugggccuugucu

SEQ ID NO: 1660 - RNA, 19 nt, Homo sapiens
ugagcugcuguaccaaaau

SEQ ID NO: 1661 - RNA, 21 nt, Homo sapiens
uaaaguaaauaugcaccaaaa

SEQ ID NO: 1662 - RNA, 20 nt, Homo sapiens
gcgugcgccggccggccgcc

SEQ ID NO: 1663 - RNA, 22 nt, Homo sapiens
caaaguuuaagauccuugaagu

SEQ ID NO: 1664 - RNA, 20 nt, Homo sapiens
aaaguagcuguaccauuugc

SEQ ID NO: 1665 - RNA, 19 nt, Homo sapiens
agguugacauacguuuccc

SEQ ID NO: 1666 - RNA, 19 nt, Homo sapiens
aggcacggugucagcaggc

SEQ ID NO: 1667 - RNA, 22 nt, Homo sapiens
ggcuggcucgcgaugucuguuu

SEQ ID NO: 1668 - RNA, 19 nt, Homo sapiens
gggcgccugugaucccaac

SEQ ID NO: 1669 - RNA, 23 nt, Homo sapiens
aguauguucuuccaggacagaac

SEQ ID NO: 1670 - RNA, 20 nt, Homo sapiens
auguauaaauguauacacac

SEQ ID NO: 1671 - RNA, 21 nt, Homo sapiens
aguuaaugaauccuggaaagu

SEQ ID NO: 1672 - RNA, 22 nt, Homo sapiens
gaaaacagcaauuaccuuugca

SEQ ID NO: 1673 - RNA, 21 nt, Homo sapiens
ugaguuggccaucugagugag

SEQ ID NO: 1674 - RNA, 20 nt, Homo sapiens
guccgcucggcgguggccca

SEQ ID NO: 1675 - RNA, 24 nt, Homo sapiens
cugaagugauguguaacugaucag

SEQ ID NO: 1676 - RNA, 21 nt, Homo sapiens
cacgcucaugcacacacccac

SEQ ID NO: 1677 - RNA, 19 nt, Homo sapiens
gagccaguuggacaggagc

SEQ ID NO: 1678 - RNA, 23 nt, Homo sapiens
auucuaauuucuccacgucuuug

SEQ ID NO: 1679 - RNA, 21 nt, Homo sapiens
uagauaaaauauugguaccug

SEQ ID NO: 1680 - RNA, 21 nt, Homo sapiens
cuucuugugcucuaggauugu

SEQ ID NO: 1681 - RNA, 23 nt, Homo sapiens
auucauuugguauaaaccgcgau

SEQ ID NO: 1682 - RNA, 22 nt, Homo sapiens
uugagaaugaugaaucauuagg

SEQ ID NO: 1683 - RNA, 21 nt, Homo sapiens
ucuuguguucucuagaucagu

SEQ ID NO: 1684 - RNA, 23 nt, Homo sapiens
uuacaguuguucaaccaguuacu

SEQ ID NO: 1685 - RNA, 21 nt, Homo sapiens
caaagaggaaggucccauuac

SEQ ID NO: 1686 - RNA, 22 nt, Homo sapiens
uuaugguuugccugggacugag

SEQ ID NO: 1687 - RNA, 19 nt, Homo sapiens
ugggcguaucuguaugcua

SEQ ID NO: 1688 - RNA, 22 nt, Homo sapiens
uaugcauuguauuuuuaggucc

SEQ ID NO: 1689 - RNA, 21 nt, Homo sapiens
uuuccauaggugaugagucac

SEQ ID NO: 1690 - RNA, 21 nt, Homo sapiens
uuggccacaauggguuagaac

SEQ ID NO: 1691 - RNA, 24 nt, Homo sapiens
ucagaacaaaugccgguucccaga

SEQ ID NO: 1692 - RNA, 22 nt, Homo sapiens
gagcuuauucauaaaagugcag

SEQ ID NO: 1693 - RNA, 20 nt, Homo sapiens
agaccauggguucucauugu

SEQ ID NO: 1694 - RNA, 22 nt, Homo sapiens
uugugucaauaugcgaugaugu

SEQ ID NO: 1695 - RNA, 25 nt, Homo sapiens
aggcaccagccaggcauugcucagc

SEQ ID NO: 1696 - RNA, 25 nt, Homo sapiens
cccaucugggguggccugugacuuu

SEQ ID NO: 1697 - RNA, 21 nt, Homo sapiens
gaagugugccguggugugucu

SEQ ID NO: 1698 - RNA, 21 nt, Homo sapiens
aagccugcccggcuccucggg

SEQ ID NO: 1699 - RNA, 22 nt, Homo sapiens
ugugucacucgaugaccacugu

SEQ ID NO: 1700 - RNA, 22 nt, Homo sapiens
uacgucaucguugucaucguca

SEQ ID NO: 1701 - RNA, 20 nt, Homo sapiens
guugugucaguuuaucaaac

SEQ ID NO: 1702 - RNA, 23 nt, Homo sapiens
acuuacagacaagagccuugcuc

SEQ ID NO: 1703 - RNA, 22 nt, Homo sapiens
uggucuaggauuguuggaggag

SEQ ID NO: 1704 - RNA, 23 nt, Homo sapiens
gacacgggcgacagcugcggccc

SEQ ID NO: 1705 - RNA, 22 nt, Homo sapiens
cacacacugcaauuacuuuugc

SEQ ID NO: 1706 - RNA, 19 nt, Homo sapiens
aggcugcggaauucaggac

SEQ ID NO: 1707 - RNA, 23 nt, Homo sapiens
uaaaucccauggugccuucuccu

SEQ ID NO: 1708 - RNA, 21 nt, Homo sapiens
aaacuacugaaaaucaaagau

SEQ ID NO: 1709 - RNA, 21 nt, Homo sapiens
guucaaauccagaucuauaac

SEQ ID NO: 1710 - RNA, 25 nt, Homo sapiens
aggggugguguugggacagcuccgu

SEQ ID NO: 1711 - RNA, 20 nt, Homo sapiens
aggguguuucucucaucucu

SEQ ID NO: 1712 - RNA, 21 nt, Homo sapiens
ugagcuaaaugugugcuggga

SEQ ID NO: 1713 - RNA, 23 nt, Homo sapiens
gcgaggaccccucggggucugac

SEQ ID NO: 1714 - RNA, 25 nt, Homo sapiens
gcugggcagggcuucugagcuccuu

SEQ ID NO: 1715 - RNA, 20 nt, Homo sapiens
aggaauguuccuucuuugcc

SEQ ID NO: 1716 - RNA, 23 nt, Homo sapiens
gaacgccuguucuugccaggugg

SEQ ID NO: 1717 - RNA, 21 nt, Homo sapiens
uccgagccugggucucccucu

SEQ ID NO: 1718 - RNA, 22 nt, Homo sapiens
acucaaaacccuucagugacuu

SEQ ID NO: 1719 - RNA, 22 nt, Homo sapiens
agacuucccauuugaagguggc

SEQ ID NO: 1720 - RNA, 23 nt, Homo sapiens
aaacucuacuuguccuucugagu

SEQ ID NO: 1721 - RNA, 24 nt, Homo sapiens
gaccuggacauguuugugcccagu

SEQ ID NO: 1722 - RNA, 20 nt, Homo sapiens
auggagauagauauagaaau

SEQ ID NO: 1723 - RNA, 21 nt, Homo sapiens
ggcuagcaacagcgcuuaccu

SEQ ID NO: 1724 - RNA, 21 nt, Homo sapiens
acagucugcugagguuggagc

SEQ ID NO: 1725 - RNA, 23 nt, Homo sapiens
aucccuugcaggggcuguugggu

SEQ ID NO: 1726 - RNA, 22 nt, Homo sapiens
uaguaccaguaccuuguguuca

SEQ ID NO: 1727 - RNA, 22 nt, Homo sapiens
agggggaaaguucuauaguccu

SEQ ID NO: 1728 - RNA, 19 nt, Homo sapiens
agcugucugaaaaugucuu

SEQ ID NO: 1729 - RNA, 22 nt, Homo sapiens
gugagucucuaagaaaagagga

SEQ ID NO: 1730 - RNA, 20 nt, Homo sapiens
ucuaguaagaguggcagucg

SEQ ID NO: 1731 - RNA, 22 nt, Homo sapiens
guucucccaacguaagcccagc

SEQ ID NO: 1732 - RNA, 22 nt, Homo sapiens
aguauucuguaccagggaaggu

SEQ ID NO: 1733 - RNA, 21 nt, Homo sapiens
agaccuggcccagaccucagc

SEQ ID NO: 1734 - RNA, 19 nt, Homo sapiens
gugucugcuuccuguggga

SEQ ID NO: 1735 - RNA, 23 nt, Homo sapiens
cuaauaguaucuaccacaauaaa

SEQ ID NO: 1736 - RNA, 22 nt, Homo sapiens
aaccagcaccccaacuuuggac

SEQ ID NO: 1737 - RNA, 23 nt, Homo sapiens
acuugggcacugaaacaaugucc

SEQ ID NO: 1738 - RNA, 24 nt, Homo sapiens
ugugcuugcucgucccgcccgcag

SEQ ID NO: 1739 - RNA, 24 nt, Homo sapiens
acugggggcuuucgggcucugcgu

SEQ ID NO: 1740 - RNA, 25 nt, Homo sapiens
agggaucgcgggcggguggcggccu

SEQ ID NO: 1741 - RNA, 23 nt, Homo sapiens
aucgcugcgguugcgagcgcugu

SEQ ID NO: 1742 - RNA, 21 nt, Homo sapiens
augauccaggaaccugccucu

SEQ ID NO: 1743 - RNA, 24 nt, Homo sapiens
aaagacauaggauagagucaccuc

SEQ ID NO: 1744 - RNA, 22 nt, Homo sapiens
gucccucuccaaaugugucuug

SEQ ID NO: 1745 - RNA, 22 nt, Homo sapiens
acuuguaugcuagcucagguag

SEQ ID NO: 1746 - RNA, 19 nt, Homo sapiens
aguguggcuuucuuagagc

SEQ ID NO: 1747 - RNA, 19 nt, Homo sapiens
ucuaggcugguacugcuga

SEQ ID NO: 1748 - RNA, 19 nt, Homo sapiens
aagcagcugccucugaggc

SEQ ID NO: 1749 - RNA, 21 nt, Homo sapiens
guggcugcacucacuuccuuc

SEQ ID NO: 1750 - RNA, 19 nt, Homo sapiens
aagugugcagggcacuggu

SEQ ID NO: 1751 - RNA, 22 nt, Homo sapiens
aaaccuguguuguucaagaguc

SEQ ID NO: 1752 - RNA, 21 nt, Homo sapiens
aggaggcagcgcucucaggac

SEQ ID NO: 1753 - RNA, 22 nt, Homo sapiens
uuuaggauaagcuugacuuuug

SEQ ID NO: 1754 - RNA, 23 nt, Homo sapiens
aauggcgccacuaggguugugca

SEQ ID NO: 1755 - RNA, 21 nt, Homo sapiens
uugaaacaaucucuacugaac

SEQ ID NO: 1756 - RNA, 22 nt, Homo sapiens
uggugggccgcagaacaugugc

SEQ ID NO: 1757 - RNA, 22 nt, Homo sapiens
auaauacaugguuaaccucuuu

SEQ ID NO: 1758 - RNA, 21 nt, Homo sapiens
aauauuauacagucaaccucu

SEQ ID NO: 1759 - RNA, 23 nt, Homo sapiens
ggcagguucucacccucucuagg

SEQ ID NO: 1760 - RNA, 25 nt, Homo sapiens
ggcggagggaaguagguccguuggu

SEQ ID NO: 1761 - RNA, 22 nt, Homo sapiens
cuugguucagggagggucccca

SEQ ID NO: 1762 - RNA, 22 nt, Homo sapiens
uacccauugcauaucggaguug

SEQ ID NO: 1763 - RNA, 24 nt, Homo sapiens
ugccugggucucuggccugcgcgu

SEQ ID NO: 1764 - RNA, 21 nt, Homo sapiens
ucccacguuguggcccagcag

SEQ ID NO: 1765 - RNA, 22 nt, Homo sapiens
aggcggggcgccgcgggaccgc

SEQ ID NO: 1766 - RNA, 23 nt, Homo sapiens
ugucacucggcucggcccacuac

SEQ ID NO: 1767 - RNA, 25 nt, Homo sapiens
aggaagcccuggaggggcuggaggu

SEQ ID NO: 1768 - RNA, 22 nt, Homo sapiens
uggaagacuagugauuuuguug

SEQ ID NO: 1769 - RNA, 22 nt, Homo sapiens
uuugugaccugguccacuaacc

SEQ ID NO: 1770 - RNA, 21 nt, Homo sapiens
uggaggagaaggaaggugaug

SEQ ID NO: 1771 - RNA, 22 nt, Homo sapiens
acuccagccccacagccucagc

SEQ ID NO: 1772 - RNA, 23 nt, Homo sapiens
ucugcucauaccccaugguuucu

SEQ ID NO: 1773 - RNA, 23 nt, Homo sapiens
ugcaccaugguugucugagcaug

SEQ ID NO: 1774 - RNA, 28 nt, Homo sapiens
ucacaaugcugacacucaaacugcugac

SEQ ID NO: 1775 - RNA, 26 nt, Homo sapiens
guuggaggaugaaaguacggagugau

SEQ ID NO: 1776 - RNA, 23 nt, Homo sapiens
cugggaucuccggggucuugguu

SEQ ID NO: 1777 - RNA, 22 nt, Homo sapiens
ugagaccucuggguucugagcu

SEQ ID NO: 1778 - RNA, 23 nt, Homo sapiens
uccaguaccacgugucagggcca

SEQ ID NO: 1779 - RNA, 24 nt, Homo sapiens
gauugcucugcgugcggaaucgac

SEQ ID NO: 1780 - RNA, 23 nt, Homo sapiens
caguaacaaagauucauccuugu

SEQ ID NO: 1781 - RNA, 23 nt, Homo sapiens
ucuuugguuaucuagcuguauga

SEQ ID NO: 1782 - RNA, 21 nt, Homo sapiens
uaaagcuagauaaccgaaagu

SEQ ID NO: 1783 - RNA, 21 nt, Homo sapiens
uauugcacuugucccggccug

SEQ ID NO: 1784 - RNA, 21 nt, Homo sapiens
uauugcacucgucccggccuc

SEQ ID NO: 1785 - RNA, 22 nt, Homo sapiens
aaagugcuguucgugcagguag

SEQ ID NO: 1786 - RNA, 22 nt, Homo sapiens
uucaacggguauuuauugagca

SEQ ID NO: 1787 - RNA, 22 nt, Homo sapiens
uuuggcacuagcacauuuuugc

SEQ ID NO: 1788 - RNA, 22 nt, Homo sapiens
ugagguaguaaguuguauuguu

SEQ ID NO: 1789 - RNA, 22 nt, Homo sapiens
aacccguagauccgaucuugug

SEQ ID NO: 1790 - RNA, 22 nt, Homo sapiens
cacccguagaaccgaccuugcg

SEQ ID NO: 1791 - RNA, 21 nt, Herpes Simplex Virus 1
uggaaggacgggaaguggaag

SEQ ID NO: 1792 - RNA, 23 nt, Kaposi sarcoma-associated herpesvirus
auuacaggaaacuggguguaagc

SEQ ID NO: 1793 - RNA, 22 nt, Kaposi sarcoma-associated herpesvirus
uaguguuguccccccgaguggc

SEQ ID NO: 1794 - RNA, 22 nt, Kaposi sarcoma-associated herpesvirus
ugguguuguccccccgaguggc

SEQ ID NO: 1795 - RNA, 22 nt, Kaposi sarcoma-associated herpesvirus
uuaaugcuuagccuguguccga

SEQ ID NO: 1796 - RNA, 22 nt, Kaposi sarcoma-associated herpesvirus
accaggccaccauuccucuccg

SEQ ID NO: 1797 - RNA, 22 nt, Kaposi sarcoma-associated herpesvirus
aacuguaguccgggucgaucug

SEQ ID NO: 1798 - RNA, 22 nt, Kaposi sarcoma-associated herpesvirus
ucacauucugaggacggcagcg

SEQ ID NO: 1799 - RNA, 21 nt, Kaposi sarcoma-associated herpesvirus
ucgcggucacagaaugugaca

SEQ ID NO: 1800 - RNA, 22 nt, Kaposi sarcoma-associated herpesvirus
uagaauacugaggccuagcuga

SEQ ID NO: 1801 - RNA, 22 nt, Kaposi sarcoma-associated herpesvirus
agcuaaaccgcaguacucuagg

SEQ ID NO: 1802 - RNA, 22 nt, Kaposi sarcoma-associated herpesvirus
uaggaugccuggaacuugccgg

SEQ ID NO: 1803 - RNA, 22 nt, Kaposi sarcoma-associated herpesvirus
ugaugguuuucgggcuguugag

SEQ ID NO: 1804 - RNA, 22 nt, Kaposi sarcoma-associated herpesvirus
ccagcagcaccuaauccaucgg

SEQ ID NO: 1805 - RNA, 21 nt, Kaposi sarcoma-associated herpesvirus
ugaucccauguugcuggcgcu

SEQ ID NO: 1806 - RNA, 22 nt, Kaposi sarcoma-associated herpesvirus
uaggcgcgacugagagagcacg

SEQ ID NO: 1807 - RNA, 22 nt, Kaposi sarcoma-associated herpesvirus
cuggguauacgcagcugcguaa

SEQ ID NO: 1808 - RNA, 22 nt, Kaposi sarcoma-associated herpesvirus
acccagcugcguaaaccccgcu

SEQ ID NO: 1809 - RNA, 22 nt, Lemur catta
ucccugagacccuaacuuguga

SEQ ID NO: 1810 - RNA, 22 nt, Lemur catta
uagcagcacauaaugguuugug

SEQ ID NO: 1811 - RNA, 22 nt, Lemur catta
uagcagcacguaaauauuggug

SEQ ID NO: 1812 - RNA, 20 nt, Lemur catta
acugcagugaaggcacuugu

SEQ ID NO: 1813 - RNA, 24 nt, Lemur catta
caaagugcuuacagugcagguagu

SEQ ID NO: 1814 - RNA, 22 nt, Lemur catta
uaaggugcaucuagugcagaua

SEQ ID NO: 1815 - RNA, 23 nt, Lemur catta
ugugcaaaucuaugcaaaacuga

SEQ ID NO: 1816 - RNA, 23 nt, Lemur catta
ugugcaaauccaugcaaaacuga

SEQ ID NO: 1817 - RNA, 22 nt, Lemur catta
uaaagugcuuauagugcaggua

SEQ ID NO: 1818 - RNA, 21 nt, Lemur catta
uaaucucagcuggcaacugug

SEQ ID NO: 1819 - RNA, 21 nt, Lemur catta
uugugcuugaucuaaccaugu

SEQ ID NO: 1820 - RNA, 22 nt, Lemur catta
aagcugccaguugaagaacugu

SEQ ID NO: 1821 - RNA, 21 nt, Lemur catta
aucacauugccagggauuucc

SEQ ID NO: 1822 - RNA, 22 nt, Lemur catta
uucacaguggcuaaguuccgcc

SEQ ID NO: 1823 - RNA, 22 nt, Lemur catta
uauugcacuugucccggccugu

SEQ ID NO: 1824 - RNA, 22 nt, Lagothrix lagotricha
aacccguagauccgaacuugug

SEQ ID NO: 1825 - RNA, 22 nt, Lagothrix lagotricha
uacaguacugugauaacugaag

SEQ ID NO: 1826 - RNA, 23 nt, Lagothrix lagotricha
agcagcauuguacagggcuauga

SEQ ID NO: 1827 - RNA, 20 nt, Lagothrix lagotricha
ucaaaugcucagacuccugu

SEQ ID NO: 1828 - RNA, 21 nt, Lagothrix lagotricha
uaaagugcugacagugcagau

SEQ ID NO: 1829 - RNA, 23 nt, Lagothrix lagotricha
agcagcauuguacagggcuauca

SEQ ID NO: 1830 - RNA, 22 nt, Lagothrix lagotricha
uuaaggcacgcggugaaugcca

SEQ ID NO: 1831 - RNA, 22 nt, Lagothrix lagotricha
ucccugagacccuaacuuguga

SEQ ID NO: 1832 - RNA, 22 nt, Lagothrix lagotricha
ucggauccgucugagcuuggcu

SEQ ID NO: 1833 - RNA, 22 nt, Lagothrix lagotricha
uugguccccuucaaccagcugu

SEQ ID NO: 1834 - RNA, 23 nt, Lagothrix lagotricha
uauggcuuuuuauuccuauguga

SEQ ID NO: 1835 - RNA, 18 nt, Lagothrix lagotricha
ucuacagugcacgugucu

SEQ ID NO: 1836 - RNA, 22 nt, Lagothrix lagotricha
ugagaugaagcacuguagcuca

SEQ ID NO: 1837 - RNA, 22 nt, Lagothrix lagotricha
uagcagcacauaaugguuugug

SEQ ID NO: 1838 - RNA, 22 nt, Lagothrix lagotricha
uagcagcacaucaugguuuaca

SEQ ID NO: 1839 - RNA, 22 nt, Lagothrix lagotricha
uagcagcacguaaauauuggcg

SEQ ID NO: 1840 - RNA, 20 nt, Lagothrix lagotricha
acugcagugaaggcacuugu

SEQ ID NO: 1841 - RNA, 24 nt, Lagothrix lagotricha
caaagugcuuacagugcagguagu

SEQ ID NO: 1842 - RNA, 22 nt, Lagothrix lagotricha
uaaggugcaucuagugcagaua

SEQ ID NO: 1843 - RNA, 23 nt, Lagothrix lagotricha
aacauucaacgcugucggugagu

SEQ ID NO: 1844 - RNA, 22 nt, Lagothrix lagotricha
accaucgaccguugauuguacc

SEQ ID NO: 1845 - RNA, 24 nt, Lagothrix lagotricha
aacauucauugcugucgguggguu

SEQ ID NO: 1846 - RNA, 22 nt, Lagothrix lagotricha
uagguaguuucauguuguuggg

SEQ ID NO: 1847 - RNA, 19 nt, Lagothrix lagotricha
gguccagaagggagcuagg

SEQ ID NO: 1848 - RNA, 23 nt, Lagothrix lagotricha
cccaguguucagacuaccuguuc

SEQ ID NO: 1849 - RNA, 23 nt, Lagothrix lagotricha
ugugcaaaucuaugcaaaacuga

SEQ ID NO: 1850 - RNA, 23 nt, Lagothrix lagotricha
ugugcaaauccaugcaaaacuga

SEQ ID NO: 1851 - RNA, 22 nt, Lagothrix lagotricha
uaaagugcuuauagugcaggua

SEQ ID NO: 1852 - RNA, 22 nt, Lagothrix lagotricha
uccuucauuccaccggagucug

SEQ ID NO: 1853 - RNA, 21 nt, Lagothrix lagotricha
uugugcuugaucuaaccaugu

SEQ ID NO: 1854 - RNA, 22 nt, Lagothrix lagotricha
aagcugccaguugaagaacugu

SEQ ID NO: 1855 - RNA, 22 nt, Lagothrix lagotricha
cauugcacuugucucggucuga

SEQ ID NO: 1856 - RNA, 22 nt, Lagothrix lagotricha
uucaaguaauccaggauaggcu

SEQ ID NO: 1857 - RNA, 22 nt, Lagothrix lagotricha
aaggagcucacagucuauugag

SEQ ID NO: 1858 - RNA, 22 nt, Lagothrix lagotricha
cuagcaccaucugaaaucgguu

SEQ ID NO: 1859 - RNA, 20 nt, Lagothrix lagotricha
uagcaccauuugaaaucagu

SEQ ID NO: 1860 - RNA, 21 nt, Lagothrix lagotricha
uguaaacauccuacacucagc

SEQ ID NO: 1861 - RNA, 23 nt, Lagothrix lagotricha
uguaaacauccuacacucucagc

SEQ ID NO: 1862 - RNA, 22 nt, Lagothrix lagotricha
uggcagugucuuagcugguugu

SEQ ID NO: 1863 - RNA, 21 nt, Lagothrix lagotricha
uggaagacuagugauuuuguu

SEQ ID NO: 1864 - RNA, 23 nt, Lagothrix lagotricha
ucuuugguuaucuagcuguauga

SEQ ID NO: 1865 - RNA, 22 nt, Lagothrix lagotricha
uauugcacuugucccggccugu

SEQ ID NO: 1866 - RNA, 22 nt, Lagothrix lagotricha
aaagugcuguucgugcagguag

SEQ ID NO: 1867 - RNA, 22 nt, Lagothrix lagotricha
uucaacggguauuuauugagca

SEQ ID NO: 1868 - RNA, 22 nt, Lagothrix lagotricha
aacccguagauccgaucuugug

SEQ ID NO: 1869 - RNA, 22 nt, Monodelphis domestica
ugagguaguagguuguauaguu

SEQ ID NO: 1870 - RNA, 22 nt, Monodelphis domestica
ugagguaguagguugugugguu

SEQ ID NO: 1871 - RNA, 21 nt, Monodelphis domestica
agagguaguagguugcauagu

SEQ ID NO: 1872 - RNA, 22 nt, Monodelphis domestica
ugagguaguagauuguauaguu

SEQ ID NO: 1873 - RNA, 21 nt, Monodelphis domestica
ugagguaguaguuuguacagu

SEQ ID NO: 1874 - RNA, 21 nt, Monodelphis domestica
ugagguaguaguuugugcugu

SEQ ID NO: 1875 - RNA, 21 nt, Monodelphis domestica
uggaauguaaagaaguaugua

SEQ ID NO: 1876 - RNA, 21 nt, Monodelphis domestica
aacccguagauccgaacuugu

SEQ ID NO: 1877 - RNA, 22 nt, Monodelphis domestica
uacaguacugugauaacugaag

SEQ ID NO: 1878 - RNA, 23 nt, Monodelphis domestica
agcagcauuguacagggcuauga

SEQ ID NO: 1879 - RNA, 23 nt, Monodelphis domestica
agcagcauuguacagggcuauca

SEQ ID NO: 1880 - RNA, 23 nt, Monodelphis domestica
uacccuguagauccgaauuugug

SEQ ID NO: 1881 - RNA, 23 nt, Monodelphis domestica
auacccuguagaaccgaauuugu

SEQ ID NO: 1882 - RNA, 25 nt, Monodelphis domestica
uggagugugacaaugguguuugugu

SEQ ID NO: 1883 - RNA, 22 nt, Monodelphis domestica
uuaaggcacgcggugaaugcca

SEQ ID NO: 1884 - RNA, 22 nt, Monodelphis domestica
ucccugagacccuaacuuguga

SEQ ID NO: 1885 - RNA, 21 nt, Monodelphis domestica
ucacagugaaccggucucuuu

SEQ ID NO: 1886 - RNA, 22 nt, Monodelphis domestica
cuuuuugcggucugggcuugcu

SEQ ID NO: 1887 - RNA, 22 nt, Monodelphis domestica
cagugcaauguaaaaagggcau

SEQ ID NO: 1888 - RNA, 22 nt, Monodelphis domestica
uaacagucuacagccauggucg

SEQ ID NO: 1889 - RNA, 22 nt, Monodelphis domestica
uugguccccuucaaccagcugu

SEQ ID NO: 1890 - RNA, 23 nt, Monodelphis domestica
uauggcuuuuuauuccuauguga

SEQ ID NO: 1891 - RNA, 22 nt, Monodelphis domestica
uauggcuuuucauuccuaugug

SEQ ID NO: 1892 - RNA, 22 nt, Monodelphis domestica
uauugcuuaagaauacgcguag

SEQ ID NO: 1893 - RNA, 17 nt, Monodelphis domestica
agcugguguugugaauc

SEQ ID NO: 1894 - RNA, 22 nt, Monodelphis domestica
uaacacugucugguaaagaugc

SEQ ID NO: 1895 - RNA, 23 nt, Monodelphis domestica
uguaguguuuccuacuuuaugga

SEQ ID NO: 1896 - RNA, 22 nt, Monodelphis domestica
ugagaugaagcacuguagcucg

SEQ ID NO: 1897 - RNA, 22 nt, Monodelphis domestica
uacaguauagaugauguacugg

SEQ ID NO: 1898 - RNA, 23 nt, Monodelphis domestica
guccaguuuucccaggaaucccu

SEQ ID NO: 1899 - RNA, 22 nt, Monodelphis domestica
ucagugcaugacagaacuuggg

SEQ ID NO: 1900 - RNA, 22 nt, Monodelphis domestica
uagcagcacauaaugguuuguu

SEQ ID NO: 1901 - RNA, 22 nt, Monodelphis domestica
uagcagcacguaaauauuggcg

SEQ ID NO: 1902 - RNA, 21 nt, Monodelphis domestica
acugcagugaaggcacuugua

SEQ ID NO: 1903 - RNA, 24 nt, Monodelphis domestica
caaagugcuuacagugcagguagu

SEQ ID NO: 1904 - RNA, 22 nt, Monodelphis domestica
uaaggugcaucuagugcagaua

SEQ ID NO: 1905 - RNA, 23 nt, Monodelphis domestica
aacauucaacgcugucggugagu

SEQ ID NO: 1906 - RNA, 22 nt, Monodelphis domestica
aacauucauugcugucgguggg

SEQ ID NO: 1907 - RNA, 23 nt, Monodelphis domestica
aacauucaacgcugucggugagu

SEQ ID NO: 1908 - RNA, 22 nt, Monodelphis domestica
uuuggcaaugguagaacucaca

SEQ ID NO: 1909 - RNA, 23 nt, Monodelphis domestica
uauggcacugguagaauucacug

SEQ ID NO: 1910 - RNA, 22 nt, Monodelphis domestica
uggacggagaacugauaagggu

SEQ ID NO: 1911 - RNA, 23 nt, Monodelphis domestica
caaagaauucuccuuuugggcuu

SEQ ID NO: 1912 - RNA, 20 nt, Monodelphis domestica
ucgugucuuguguugcagcc

SEQ ID NO: 1913 - RNA, 22 nt, Monodelphis domestica
caacggaaucccaaaagcagcu

SEQ ID NO: 1914 - RNA, 21 nt, Monodelphis domestica
aacuggccuacaaagucccag

SEQ ID NO: 1915 - RNA, 21 nt, Monodelphis domestica
uagguaguuuccuguuguugg

SEQ ID NO: 1916 - RNA, 23 nt, Monodelphis domestica
cccaguguuuagacuaucuguuc

SEQ ID NO: 1917 - RNA, 23 nt, Monodelphis domestica
ugugcaaaucuaugcaaaacuga

SEQ ID NO: 1918 - RNA, 23 nt, Monodelphis domestica
ugugcaaauccaugcaaaacuga

SEQ ID NO: 1919 - RNA, 23 nt, Monodelphis domestica
uaaagugcuuauagugcagguag

SEQ ID NO: 1920 - RNA, 22 nt, Monodelphis domestica
uaacacugucugguaacgaugu

SEQ ID NO: 1921 - RNA, 22 nt, Monodelphis domestica
caucuuacuagacagugcugga

SEQ ID NO: 1922 - RNA, 22 nt, Monodelphis domestica
uaauacugccugguaaugauga

SEQ ID NO: 1923 - RNA, 22 nt, Monodelphis domestica
uaauacugccggguaaugaugg

SEQ ID NO: 1924 - RNA, 22 nt, Monodelphis domestica
gugaaauguuuaggaccacuug

SEQ ID NO: 1925 - RNA, 22 nt, Monodelphis domestica
uucccuuugucauccuaugccu

SEQ ID NO: 1926 - RNA, 21 nt, Monodelphis domestica
uggaauguaaggaagugugug

SEQ ID NO: 1927 - RNA, 22 nt, Monodelphis domestica
auaagacgagcaaaaagcucgu

SEQ ID NO: 1928 - RNA, 22 nt, Monodelphis domestica
uagcuuaucagacugauguuga

SEQ ID NO: 1929 - RNA, 21 nt, Monodelphis domestica
uaacagucuccagucacggcc

SEQ ID NO: 1930 - RNA, 21 nt, Monodelphis domestica
acagcaggcacagacaggcag

SEQ ID NO: 1931 - RNA, 21 nt, Monodelphis domestica
uaaucucagcuggcaacugug

SEQ ID NO: 1932 - RNA, 24 nt, Monodelphis domestica
uacugcaucaggaacugauuggau

SEQ ID NO: 1933 - RNA, 21 nt, Monodelphis domestica
uugugcuugaucuaaccaugu

SEQ ID NO: 1934 - RNA, 21 nt, Monodelphis domestica
ugauuguccaaacgcaauucu

SEQ ID NO: 1935 - RNA, 22 nt, Monodelphis domestica
aagcugccaguugaagaacugc

SEQ ID NO: 1936 - RNA, 23 nt, Monodelphis domestica
agcuacauugucugcuggguuuc

SEQ ID NO: 1937 - RNA, 24 nt, Monodelphis domestica
agcuacaucuggcuacugggucuc

SEQ ID NO: 1938 - RNA, 21 nt, Monodelphis domestica
ugucaguuugucaaauacccc

SEQ ID NO: 1939 - RNA, 20 nt, Monodelphis domestica
aucacauugccagggauuuc

SEQ ID NO: 1940 - RNA, 21 nt, Monodelphis domestica
aucacauugccagggauuacc

SEQ ID NO: 1941 - RNA, 16 nt, Monodelphis domestica
uggcucaguucagcag

SEQ ID NO: 1942 - RNA, 22 nt, Monodelphis domestica
cauugcacuugucucggucuga

SEQ ID NO: 1943 - RNA, 21 nt, Monodelphis domestica
uucacaguggcuaaguuccgc

SEQ ID NO: 1944 - RNA, 21 nt, Monodelphis domestica
uucacaguggcuaaguucugc

SEQ ID NO: 1945 - RNA, 20 nt, Monodelphis domestica
uagcaccauuugaaaucggu

SEQ ID NO: 1946 - RNA, 20 nt, Monodelphis domestica
uagcaccauuugaaaucagu

SEQ ID NO: 1947 - RNA, 20 nt, Monodelphis domestica
uaagugcuuccauguuuuag

SEQ ID NO: 1948 - RNA, 20 nt, Monodelphis domestica
uaagugcuuccauguuuugg

SEQ ID NO: 1949 - RNA, 21 nt, Monodelphis domestica
uaagugcuuccauguuucagu

SEQ ID NO: 1950 - RNA, 21 nt, Monodelphis domestica
uaagugcuuccauguuugagu

SEQ ID NO: 1951 - RNA, 22 nt, Monodelphis domestica
uguaaacauccucgacuggaag

SEQ ID NO: 1952 - RNA, 24 nt, Monodelphis domestica
ggaggcaagauguuggcauagcug

SEQ ID NO: 1953 - RNA, 21 nt, Monodelphis domestica
uauugcacauuacuaaguugc

SEQ ID NO: 1954 - RNA, 23 nt, Monodelphis domestica
uccagcaucagugauuuuguuga

SEQ ID NO: 1955 - RNA, 23 nt, Monodelphis domestica
uggcagugucuuagcugguuguu

SEQ ID NO: 1956 - RNA, 22 nt, Monodelphis domestica
uaaugccccuaaaaauccuuau

SEQ ID NO: 1957 - RNA, 23 nt, Monodelphis domestica
gaauugcacuuuagcaaugguga

SEQ ID NO: 1958 - RNA, 23 nt, Monodelphis domestica
uuuuguucguucggcucgcguga

SEQ ID NO: 1959 - RNA, 22 nt, Monodelphis domestica
agaucagaaggugauuguggcu

SEQ ID NO: 1960 - RNA, 22 nt, Monodelphis domestica
aucgggaauaucguguccgucc

SEQ ID NO: 1961 - RNA, 22 nt, Monodelphis domestica
uggcaguguauuguuagcuggu

SEQ ID NO: 1962 - RNA, 22 nt, Monodelphis domestica
aaaccguuaccauuacuguguu

SEQ ID NO: 1963 - RNA, 22 nt, Monodelphis domestica
uggaagacuagugauuuuguug

SEQ ID NO: 1964 - RNA, 23 nt, Monodelphis domestica
ucuuugguuaucuagcuguauga

SEQ ID NO: 1965 - RNA, 21 nt, Monodelphis domestica
uaaagcuagauaaccgaaagu

SEQ ID NO: 1966 - RNA, 21 nt, Monodelphis domestica
uauugcacuugucccggccug

SEQ ID NO: 1967 - RNA, 22 nt, Monodelphis domestica
aaagugcuguucgugcagguag

SEQ ID NO: 1968 - RNA, 23 nt, Monodelphis domestica
uuuggcacuagcacauuuuugcu

SEQ ID NO: 1969 - RNA, 20 nt, Mareks disease virus
ugcuuguucacugugcggca

SEQ ID NO: 1970 - RNA, 23 nt, Mareks disease virus
guuguauucugcccgguaguccg

SEQ ID NO: 1971 - RNA, 21 nt, Mareks disease virus
cggacugccgcagaauagcuu

SEQ ID NO: 1972 - RNA, 24 nt, Mareks disease virus
augaaaaugugaaaccucucccgc

SEQ ID NO: 1973 - RNA, 23 nt, Mareks disease virus
uuaaugcuguaucggaacccuuc

SEQ ID NO: 1974 - RNA, 21 nt, Mareks disease virus
aaugguucugacagcaugacc

SEQ ID NO: 1975 - RNA, 23 nt, Mareks disease virus
uguguaucguggucgucuacugu

SEQ ID NO: 1976 - RNA, 22 nt, Mareks disease virus
gagaucccugcgaaaugacagu

SEQ ID NO: 1977 - RNA, 23 nt, Mareks disease virus
ucgagaucucuacgagauuacag

SEQ ID NO: 1978 - RNA, 22 nt, Mareks disease virus
gugaccucuacggaacaauagu

SEQ ID NO: 1979 - RNA, 22 nt, Mouse gammaherpesvirus 68
uagaaauggccguacuuccuuu

SEQ ID NO: 1980 - RNA, 22 nt, Mouse gammaherpesvirus 68
cagacccccucucccccucuuu

SEQ ID NO: 1981 - RNA, 22 nt, Mouse gammaherpesvirus 68
gaggugagcaggaguugcgcuu

SEQ ID NO: 1982 - RNA, 22 nt, Mouse gammaherpesvirus 68
ucgaggagcacguguuauucua

SEQ ID NO: 1983 - RNA, 22 nt, Mouse gammaherpesvirus 68
agaguugagaucgggucgucuc

SEQ ID NO: 1984 - RNA, 22 nt, Mouse gammaherpesvirus 68
ugaaacugugugaggugguuuu

SEQ ID NO: 1985 - RNA, 21 nt, Mouse gammaherpesvirus 68
gauaucgcgcccaccuuuauu

SEQ ID NO: 1986 - RNA, 22 nt, Mouse gammaherpesvirus 68
aaagguggaggugcgguaaccu

SEQ ID NO: 1987 - RNA, 22 nt, Mouse gammaherpesvirus 68
agcacucacuggggguuugguc

SEQ ID NO: 1988 - RNA, 22 nt, Mouse gammaherpesvirus 68
ucacauuugccuggaccuuuuu

SEQ ID NO: 1989 - RNA, 22 nt, Macaca mulatta
aacccguagauccgaacuugug

SEQ ID NO: 1990 - RNA, 22 nt, Macaca mulatta
uacaguacugugauaacugaag

SEQ ID NO: 1991 - RNA, 23 nt, Macaca mulatta
agcagcauuguacagggcuauga

SEQ ID NO: 1992 - RNA, 20 nt, Macaca mulatta
ucaaaugcucagacuccugu

SEQ ID NO: 1993 - RNA, 24 nt, Macaca mulatta
aaaagugcuuacagugcagguagc

SEQ ID NO: 1994 - RNA, 21 nt, Macaca mulatta
uaaagugcugacagugcagau

SEQ ID NO: 1995 - RNA, 23 nt, Macaca mulatta
agcagcauuguacagggcuauca

SEQ ID NO: 1996 - RNA, 22 nt, Macaca mulatta
uuaaggcacgcggugaaugcca

SEQ ID NO: 1997 - RNA, 22 nt, Macaca mulatta
ucccugagacccuaacuuguga

SEQ ID NO: 1998 - RNA, 22 nt, Macaca mulatta
ucggauccgucugagcuuggcu

SEQ ID NO: 1999 - RNA, 22 nt, Macaca mulatta
ucacagugaaccggucucuuuu

SEQ ID NO: 2000 - RNA, 20 nt, Macaca mulatta
cagugcaauguuaaaagggc

SEQ ID NO: 2001 - RNA, 21 nt, Macaca mulatta
uuguccccuucaaccagcugu

SEQ ID NO: 2002 - RNA, 23 nt, Macaca mulatta
uauggcuuuuuauuccuauguga

SEQ ID NO: 2003 - RNA, 21 nt, Macaca mulatta
aacacugucugguaaagaugg

SEQ ID NO: 2004 - RNA, 24 nt, Macaca mulatta
guccaguuuucccaggaaucccuu

SEQ ID NO: 2005 - RNA, 20 nt, Macaca mulatta
uugcauagucacaaaaguga

SEQ ID NO: 2006 - RNA, 22 nt, Macaca mulatta
uagcagcacauaaugguuugug

SEQ ID NO: 2007 - RNA, 22 nt, Macaca mulatta
uagcagcacaucaugguuuaca

SEQ ID NO: 2008 - RNA, 22 nt, Macaca mulatta
uagcagcacguaaauauuggcg

SEQ ID NO: 2009 - RNA, 20 nt, Macaca mulatta
acugcagugaaggcacuugu

SEQ ID NO: 2010 - RNA, 24 nt, Macaca mulatta
caaagugcuuacagugcagguagu

SEQ ID NO: 2011 - RNA, 22 nt, Macaca mulatta
uaaggugcaucuagugcagaua

SEQ ID NO: 2012 - RNA, 23 nt, Macaca mulatta
aacauucaacgcugucggugagu

SEQ ID NO: 2013 - RNA, 22 nt, Macaca mulatta
accaucgaccguugauuguacc

SEQ ID NO: 2014 - RNA, 24 nt, Macaca mulatta
aacauucauugcugucgguggguu

SEQ ID NO: 2015 - RNA, 22 nt, Macaca mulatta
aacauucaaccugucggugagu

SEQ ID NO: 2016 - RNA, 22 nt, Macaca mulatta
uuuggcaaugguagaacucaca

SEQ ID NO: 2017 - RNA, 23 nt, Macaca mulatta
uauggcacugguagaauucacug

SEQ ID NO: 2018 - RNA, 22 nt, Macaca mulatta
caucccuugcaugguggagggu

SEQ ID NO: 2019 - RNA, 23 nt, Macaca mulatta
gugccuacugagcugauaucagu

SEQ ID NO: 2020 - RNA, 22 nt, Macaca mulatta
ugauauguuugauauauuaggu

SEQ ID NO: 2021 - RNA, 22 nt, Macaca mulatta
uguaacagcaacuccaugugga

SEQ ID NO: 2022 - RNA, 21 nt, Macaca mulatta
uagguaguuucauguuguugg

SEQ ID NO: 2023 - RNA, 19 nt, Macaca mulatta
gguccagaggggaaauagg

SEQ ID NO: 2024 - RNA, 23 nt, Macaca mulatta
cccaguguucagacuaccuguuc

SEQ ID NO: 2025 - RNA, 23 nt, Macaca mulatta
ugugcaaaucuaugcaaaacuga

SEQ ID NO: 2026 - RNA, 23 nt, Macaca mulatta
ugugcaaauccaugcaaaacuga

SEQ ID NO: 2027 - RNA, 22 nt, Macaca mulatta
uaaagugcuuauagugcaggua

SEQ ID NO: 2028 - RNA, 22 nt, Macaca mulatta
aauacugccggguaaugaugga

SEQ ID NO: 2029 - RNA, 22 nt, Macaca mulatta
uagcuuaucagacugauguuga

SEQ ID NO: 2030 - RNA, 22 nt, Macaca mulatta
uucccuuugucauccuuugccu

SEQ ID NO: 2031 - RNA, 21 nt, Macaca mulatta
acagcaggcacagacaggcag

SEQ ID NO: 2032 - RNA, 21 nt, Macaca mulatta
augaccuaugaauugacagac

SEQ ID NO: 2033 - RNA, 21 nt, Macaca mulatta
uugugcuugaucuaaccaugu

SEQ ID NO: 2034 - RNA, 21 nt, Macaca mulatta
ugauuguccaaacgcaauucu

SEQ ID NO: 2035 - RNA, 22 nt, Macaca mulatta
aagcugccaguugaagaacugu

SEQ ID NO: 2036 - RNA, 22 nt, Macaca mulatta
ccaccaccaugucugacacuuu

SEQ ID NO: 2037 - RNA, 23 nt, Macaca mulatta
agcuacauugucugcuggguuuc

SEQ ID NO: 2038 - RNA, 21 nt, Macaca mulatta
ugucaguuugucaaauacccc

SEQ ID NO: 2039 - RNA, 23 nt, Macaca mulatta
caagucacuagugguuccguuua

SEQ ID NO: 2040 - RNA, 21 nt, Macaca mulatta
aucacauugccagggauuucc

SEQ ID NO: 2041 - RNA, 22 nt, Macaca mulatta
uggcucaguucagcaggaacag

SEQ ID NO: 2042 - RNA, 22 nt, Macaca mulatta
cauugcacuugucucggucuga

SEQ ID NO: 2043 - RNA, 22 nt, Macaca mulatta
uucaaguaauccaggauaggcu

SEQ ID NO: 2044 - RNA, 22 nt, Macaca mulatta
uucacaguggcuaaguuccgcc

SEQ ID NO: 2045 - RNA, 22 nt, Macaca mulatta
aaggagcucacagucuauugag

SEQ ID NO: 2046 - RNA, 22 nt, Macaca mulatta
cuagcaccaucugaaaucgguu

SEQ ID NO: 2047 - RNA, 22 nt, Macaca mulatta
cuuucagucggauguuugcagc

SEQ ID NO: 2048 - RNA, 22 nt, Macaca mulatta
uguaaacauccucgacuggaag

SEQ ID NO: 2049 - RNA, 21 nt, Macaca mulatta
uguaaacauccuacacucagc

SEQ ID NO: 2050 - RNA, 21 nt, Macaca mulatta
ggcaagaugcuggcauagcug

SEQ ID NO: 2051 - RNA, 21 nt, Macaca mulatta
uauugcacauuacuaaguugc

SEQ ID NO: 2052 - RNA, 19 nt, Macaca mulatta
gugcauuguaguugcauug

SEQ ID NO: 2053 - RNA, 22 nt, Macaca mulatta
uggcagugucuuagcugguugu

SEQ ID NO: 2054 - RNA, 22 nt, Macaca mulatta
uauugcacuugucccggccugu

SEQ ID NO: 2055 - RNA, 22 nt, Macaca mulatta
aaagugcuguucgugcagguag

SEQ ID NO: 2056 - RNA, 22 nt, Macaca mulatta
uuuggcacuagcacauuuuugc

SEQ ID NO: 2057 - RNA, 22 nt, Macaca mulatta
ugagguaguaaguuguauuguu

SEQ ID NO: 2058 - RNA, 22 nt, Macaca mulatta
aacccguagauccgaucuugug

SEQ ID NO: 2059 - RNA, 21 nt, Mus musculus
ugagguaguagguuguauagu

SEQ ID NO: 2060 - RNA, 22 nt, Mus musculus
ugagguaguagguugugugguu

SEQ ID NO: 2061 - RNA, 22 nt, Mus musculus
ugagguaguagguuguaugguu

SEQ ID NO: 2062 - RNA, 21 nt, Mus musculus
agagguaguagguugcauagu

SEQ ID NO: 2063 - RNA, 22 nt, Mus musculus
cuauacgaccugcugccuuucu

SEQ ID NO: 2064 - RNA, 21 nt, Mus musculus
ugagguaggagguuguauagu

SEQ ID NO: 2065 - RNA, 21 nt, Mus musculus
ugagguaguagauuguauagu

SEQ ID NO: 2066 - RNA, 21 nt, Mus musculus
ugagguaguaguuuguacagu

SEQ ID NO: 2067 - RNA, 21 nt, Mus musculus
ugagguaguaguuugugcugu

SEQ ID NO: 2068 - RNA, 21 nt, Mus musculus
uggaauguaaagaaguaugua

SEQ ID NO: 2069 - RNA, 22 nt, Mus musculus
aacccguagauccgaacuugug

SEQ ID NO: 2070 - RNA, 22 nt, Mus musculus
uacaguacugugauaacugaag

SEQ ID NO: 2071 - RNA, 22 nt, Mus musculus
uacaguacugugauagcugaag

SEQ ID NO: 2072 - RNA, 23 nt, Mus musculus
agcagcauuguacagggcuauga

SEQ ID NO: 2073 - RNA, 22 nt, Mus musculus
caaagugcuaacagugcaggua

SEQ ID NO: 2074 - RNA, 21 nt, Mus musculus
uaaagugcugacagugcagau

SEQ ID NO: 2075 - RNA, 23 nt, Mus musculus
agcagcauuguacagggcuauca

SEQ ID NO: 2076 - RNA, 23 nt, Mus musculus
uacccuguagauccgaauuugug

SEQ ID NO: 2077 - RNA, 22 nt, Mus musculus
cccuguagaaccgaauuugugu

SEQ ID NO: 2078 - RNA, 23 nt, Mus musculus
uggagugugacaaugguguuugu

SEQ ID NO: 2079 - RNA, 20 nt, Mus musculus
uaaggcacgcggugaaugcc

SEQ ID NO: 2080 - RNA, 23 nt, Mus musculus
ucccugagacccuuuaaccugug

SEQ ID NO: 2081 - RNA, 22 nt, Mus musculus
ucccugagacccuaacuuguga

SEQ ID NO: 2082 - RNA, 21 nt, Mus musculus
ucguaccgugaguaauaaugc

SEQ ID NO: 2083 - RNA, 21 nt, Mus musculus
cauuauuacuuuugguacgcg

SEQ ID NO: 2084 - RNA, 21 nt, Mus musculus
ucggauccgucugagcuuggc

SEQ ID NO: 2085 - RNA, 22 nt, Mus musculus
ucacagugaaccggucucuuuu

SEQ ID NO: 2086 - RNA, 22 nt, Mus musculus
ucacagugaaccggucucuuuc

SEQ ID NO: 2087 - RNA, 22 nt, Mus musculus
aagcccuuaccccaaaaagcau

SEQ ID NO: 2088 - RNA, 22 nt, Mus musculus
cuuuuugcggucugggcuugcu

SEQ ID NO: 2089 - RNA, 22 nt, Mus musculus
cagugcaauguuaaaagggcau

SEQ ID NO: 2090 - RNA, 22 nt, Mus musculus
cagugcaaugaugaaagggcau

SEQ ID NO: 2091 - RNA, 22 nt, Mus musculus
uaacagucuacagccauggucg

SEQ ID NO: 2092 - RNA, 22 nt, Mus musculus
uugguccccuucaaccagcugu

SEQ ID NO: 2093 - RNA, 21 nt, Mus musculus
gcugguaaaauggaaccaaau

SEQ ID NO: 2094 - RNA, 21 nt, Mus musculus
uugguccccuucaaccagcua

SEQ ID NO: 2095 - RNA, 22 nt, Mus musculus
ugugacugguugaccagagggg

SEQ ID NO: 2096 - RNA, 23 nt, Mus musculus
uauggcuuuuuauuccuauguga

SEQ ID NO: 2097 - RNA, 22 nt, Mus musculus
uauggcuuuucauuccuaugug

SEQ ID NO: 2098 - RNA, 23 nt, Mus musculus
acuccauuuguuuugaugaugga

SEQ ID NO: 2099 - RNA, 23 nt, Mus musculus
uuauugcuuaagaauacgcguag

SEQ ID NO: 2100 - RNA, 17 nt, Mus musculus
agcugguguugugaauc

SEQ ID NO: 2101 - RNA, 18 nt, Mus musculus
ucuacagugcacgugucu

SEQ ID NO: 2102 - RNA, 22 nt, Mus musculus
cagugguuuuacccuaugguag

SEQ ID NO: 2103 - RNA, 22 nt, Mus musculus
uaccacaggguagaaccacgga

SEQ ID NO: 2104 - RNA, 22 nt, Mus musculus
uaacacugucugguaaagaugg

SEQ ID NO: 2105 - RNA, 22 nt, Mus musculus
uguaguguuuccuacuuuaugg

SEQ ID NO: 2106 - RNA, 20 nt, Mus musculus
cauaaaguagaaagcacuac

SEQ ID NO: 2107 - RNA, 22 nt, Mus musculus
ugagaugaagcacuguagcuca

SEQ ID NO: 2108 - RNA, 22 nt, Mus musculus
uacaguauagaugauguacuag

SEQ ID NO: 2109 - RNA, 24 nt, Mus musculus
guccaguuuucccaggaaucccuu

SEQ ID NO: 2110 - RNA, 22 nt, Mus musculus
ugagaacugaauuccauggguu

SEQ ID NO: 2111 - RNA, 22 nt, Mus musculus
ugagaacugaauuccauaggcu

SEQ ID NO: 2112 - RNA, 22 nt, Mus musculus
ucagugcacuacagaacuuugu

SEQ ID NO: 2113 - RNA, 22 nt, Mus musculus
ucagugcaucacagaacuuugu

SEQ ID NO: 2114 - RNA, 22 nt, Mus musculus
ucuggcuccgugucuucacucc

SEQ ID NO: 2115 - RNA, 22 nt, Mus musculus
ucucccaacccuuguaccagug

SEQ ID NO: 2116 - RNA, 21 nt, Mus musculus
cuagacugaggcuccuugagg

SEQ ID NO: 2117 - RNA, 22 nt, Mus musculus
ucagugcaugacagaacuuggg

SEQ ID NO: 2118 - RNA, 22 nt, Mus musculus
uugcauagucacaaaagugauc

SEQ ID NO: 2119 - RNA, 22 nt, Mus musculus
uagguuauccguguugccuucg

SEQ ID NO: 2120 - RNA, 22 nt, Mus musculus
uuaaugcuaauugugauagggg

SEQ ID NO: 2121 - RNA, 22 nt, Mus musculus
uagcagcacauaaugguuugug

SEQ ID NO: 2122 - RNA, 22 nt, Mus musculus
uagcagcacaucaugguuuaca

SEQ ID NO: 2123 - RNA, 22 nt, Mus musculus
uagcagcacguaaauauuggcg

SEQ ID NO: 2124 - RNA, 21 nt, Mus musculus
acugcagugagggcacuugua

SEQ ID NO: 2125 - RNA, 24 nt, Mus musculus
caaagugcuuacagugcagguagu

SEQ ID NO: 2126 - RNA, 22 nt, Mus musculus
uaaggugcaucuagugcagaua

SEQ ID NO: 2127 - RNA, 23 nt, Mus musculus
aacauucaacgcugucggugagu

SEQ ID NO: 2128 - RNA, 22 nt, Mus musculus
accaucgaccguugauuguacc

SEQ ID NO: 2129 - RNA, 22 nt, Mus musculus
aacauucauugcugucgguggg

SEQ ID NO: 2130 - RNA, 22 nt, Mus musculus
aacauucaaccugucggugagu

SEQ ID NO: 2131 - RNA, 22 nt, Mus musculus
uuuggcaaugguagaacucaca

SEQ ID NO: 2132 - RNA, 23 nt, Mus musculus
uauggcacugguagaauucacug

SEQ ID NO: 2133 - RNA, 22 nt, Mus musculus
uggacggagaacugauaagggu

SEQ ID NO: 2134 - RNA, 18 nt, Mus musculus
uggagagaaaggcaguuc

SEQ ID NO: 2135 - RNA, 23 nt, Mus musculus
caaagaauucuccuuuugggcuu

SEQ ID NO: 2136 - RNA, 22 nt, Mus musculus
ucgugucuuguguugcagccgg

SEQ ID NO: 2137 - RNA, 22 nt, Mus musculus
caucccuugcaugguggagggu

SEQ ID NO: 2138 - RNA, 23 nt, Mus musculus
gugccuacugagcugauaucagu

SEQ ID NO: 2139 - RNA, 22 nt, Mus musculus
ugauauguuugauauauuaggu

SEQ ID NO: 2140 - RNA, 22 nt, Mus musculus
caacggaaucccaaaagcagcu

SEQ ID NO: 2141 - RNA, 18 nt, Mus musculus
cugaccuaugaauugaca

SEQ ID NO: 2142 - RNA, 21 nt, Mus musculus
aacuggccuacaaagucccag

SEQ ID NO: 2143 - RNA, 22 nt, Mus musculus
uguaacagcaacuccaugugga

SEQ ID NO: 2144 - RNA, 21 nt, Mus musculus
uagcagcacagaaauauuggc

SEQ ID NO: 2145 - RNA, 21 nt, Mus musculus
uagguaguuucauguuguugg

SEQ ID NO: 2146 - RNA, 21 nt, Mus musculus
uagguaguuuccuguuguugg

SEQ ID NO: 2147 - RNA, 23 nt, Mus musculus
cccaguguucagacuaccuguuc

SEQ ID NO: 2148 - RNA, 22 nt, Mus musculus
uacaguagucugcacauugguu

SEQ ID NO: 2149 - RNA, 23 nt, Mus musculus
cccaguguuuagacuaccuguuc

SEQ ID NO: 2150 - RNA, 23 nt, Mus musculus
ugugcaaaucuaugcaaaacuga

SEQ ID NO: 2151 - RNA, 23 nt, Mus musculus
ugugcaaauccaugcaaaacuga

SEQ ID NO: 2152 - RNA, 22 nt, Mus musculus
uaacacugucugguaacgaugu

SEQ ID NO: 2153 - RNA, 23 nt, Mus musculus
uaauacugccugguaaugaugac

SEQ ID NO: 2154 - RNA, 22 nt, Mus musculus
uaauacugccggguaaugaugg

SEQ ID NO: 2155 - RNA, 21 nt, Mus musculus
uacucaguaaggcauuguucu

SEQ ID NO: 2156 - RNA, 22 nt, Mus musculus
agagguauagcgcaugggaaga

SEQ ID NO: 2157 - RNA, 21 nt, Mus musculus
ugaaauguuuaggaccacuag

SEQ ID NO: 2158 - RNA, 23 nt, Mus musculus
uucccuuugucauccuaugccug

SEQ ID NO: 2159 - RNA, 22 nt, Mus musculus
uccuucauuccaccggagucug

SEQ ID NO: 2160 - RNA, 22 nt, Mus musculus
uggaauguaaggaagugugugg

SEQ ID NO: 2161 - RNA, 23 nt, Mus musculus
gcuucuccuggcucuccucccuc

SEQ ID NO: 2162 - RNA, 22 nt, Mus musculus
auaagacgagcaaaaagcuugu

SEQ ID NO: 2163 - RNA, 23 nt, Mus musculus
uaaagugcuuauagugcagguag

SEQ ID NO: 2164 - RNA, 22 nt, Mus musculus
caaagugcucauagugcaggua

SEQ ID NO: 2165 - RNA, 22 nt, Mus musculus
uagcuuaucagacugauguuga

SEQ ID NO: 2166 - RNA, 22 nt, Mus musculus
cugugcgugugacagcggcuga

SEQ ID NO: 2167 - RNA, 22 nt, Mus musculus
uucccuuugucauccuuugccu

SEQ ID NO: 2168 - RNA, 21 nt, Mus musculus
uaacagucuccagucacggcc

SEQ ID NO: 2169 - RNA, 21 nt, Mus musculus
acagcaggcacagacaggcag

SEQ ID NO: 2170 - RNA, 21 nt, Mus musculus
augaccuaugauuugacagac

SEQ ID NO: 2171 - RNA, 21 nt, Mus musculus
uaaucucagcuggcaacugug

SEQ ID NO: 2172 - RNA, 25 nt, Mus musculus
gggaaaucucugcaggcaaauguga

SEQ ID NO: 2173 - RNA, 24 nt, Mus musculus
uacugcaucaggaacugacuggau

SEQ ID NO: 2174 - RNA, 21 nt, Mus musculus
uugugcuugaucuaaccaugu

SEQ ID NO: 2175 - RNA, 21 nt, Mus musculus
ugauuguccaaacgcaauucu

SEQ ID NO: 2176 - RNA, 22 nt, Mus musculus
aagcugccaguugaagaacugu

SEQ ID NO: 2177 - RNA, 22 nt, Mus musculus
agcuacauugucugcuggguuu

SEQ ID NO: 2178 - RNA, 24 nt, Mus musculus
agcuacaucuggcuacugggucuc

SEQ ID NO: 2179 - RNA, 21 nt, Mus musculus
ugucaguuugucaaauacccc

SEQ ID NO: 2180 - RNA, 23 nt, Mus musculus
uaagucacuagugguuccguuua

SEQ ID NO: 2181 - RNA, 21 nt, Mus musculus
aucacauugccagggauuucc

SEQ ID NO: 2182 - RNA, 21 nt, Mus musculus
aucacauugccagggauuacc

SEQ ID NO: 2183 - RNA, 22 nt, Mus musculus
uggcucaguucagcaggaacag

SEQ ID NO: 2184 - RNA, 22 nt, Mus musculus
cauugcacuugucucggucuga

SEQ ID NO: 2185 - RNA, 21 nt, Mus musculus
uucaaguaauccaggauaggc

SEQ ID NO: 2186 - RNA, 22 nt, Mus musculus
uucaaguaauucaggauagguu

SEQ ID NO: 2187 - RNA, 21 nt, Mus musculus
uucacaguggcuaaguuccgc

SEQ ID NO: 2188 - RNA, 21 nt, Mus musculus
uucacaguggcuaaguucugc

SEQ ID NO: 2189 - RNA, 22 nt, Mus musculus
aaggagcucacagucuauugag

SEQ ID NO: 2190 - RNA, 23 nt, Mus musculus
cucaaacuaugggggcacuuuuu

SEQ ID NO: 2191 - RNA, 23 nt, Mus musculus
aaagugcuuccacuuugugugcc

SEQ ID NO: 2192 - RNA, 22 nt, Mus musculus
caucaaaguggaggcccucucu

SEQ ID NO: 2193 - RNA, 23 nt, Mus musculus
aaagugcauccauuuuguuuguc

SEQ ID NO: 2194 - RNA, 21 nt, Mus musculus
gaucaaaguggaggcccucuc

SEQ ID NO: 2195 - RNA, 23 nt, Mus musculus
aagugccgccagguuuugagugu

SEQ ID NO: 2196 - RNA, 22 nt, Mus musculus
acucaaacugggggcucuuuug

SEQ ID NO: 2197 - RNA, 22 nt, Mus musculus
agugccgcagaguuuguagugu

SEQ ID NO: 2198 - RNA, 22 nt, Mus musculus
aaagugcuucccuuuugugugu

SEQ ID NO: 2199 - RNA, 23 nt, Mus musculus
aaagugcuacuacuuuugagucu

SEQ ID NO: 2200 - RNA, 21 nt, Mus musculus
agggcccccccucaauccugu

SEQ ID NO: 2201 - RNA, 21 nt, Mus musculus
auguaugugugcaugugcaug

SEQ ID NO: 2202 - RNA, 22 nt, Mus musculus
auguaugugugcaugaacaugu

SEQ ID NO: 2203 - RNA, 22 nt, Mus musculus
ggcagaggagggcuguucuucc

SEQ ID NO: 2204 - RNA, 22 nt, Mus musculus
ugguuuaccgucccacauacau

SEQ ID NO: 2205 - RNA, 21 nt, Mus musculus
uagcaccaucugaaaucgguu

SEQ ID NO: 2206 - RNA, 23 nt, Mus musculus
uagcaccauuugaaaucaguguu

SEQ ID NO: 2207 - RNA, 20 nt, Mus musculus
uagcaccauuugaaaucggu

SEQ ID NO: 2208 - RNA, 22 nt, Mus musculus
uaugcaagggcaagcucucuuc

SEQ ID NO: 2209 - RNA, 23 nt, Mus musculus
cagugcaauaguauugucaaagc

SEQ ID NO: 2210 - RNA, 24 nt, Mus musculus
cagugcaaugguauugucaaagca

SEQ ID NO: 2211 - RNA, 23 nt, Mus musculus
uaagugcuuccauguuuugguga

SEQ ID NO: 2212 - RNA, 22 nt, Mus musculus
aagugcuuccauguuuuaguag

SEQ ID NO: 2213 - RNA, 23 nt, Mus musculus
acuuuaacaugggaaugcuuucu

SEQ ID NO: 2214 - RNA, 23 nt, Mus musculus
caagugcuuccauguuucagugg

SEQ ID NO: 2215 - RNA, 22 nt, Mus musculus
uuuaacaugggguuaccugcug

SEQ ID NO: 2216 - RNA, 22 nt, Mus musculus
aagugcuuccauguuugagugu

SEQ ID NO: 2217 - RNA, 22 nt, Mus musculus
cuuucagucggauguuugcagc

SEQ ID NO: 2218 - RNA, 22 nt, Mus musculus
uguaaacauccucgacuggaag

SEQ ID NO: 2219 - RNA, 22 nt, Mus musculus
uguaaacauccuacacucagcu

SEQ ID NO: 2220 - RNA, 23 nt, Mus musculus
uguaaacauccuacacucucagc

SEQ ID NO: 2221 - RNA, 22 nt, Mus musculus
uguaaacauccccgacuggaag

SEQ ID NO: 2222 - RNA, 20 nt, Mus musculus
uguaaacauccuugacugga

SEQ ID NO: 2223 - RNA, 21 nt, Mus musculus
cuuucagucggauguuuacag

SEQ ID NO: 2224 - RNA, 22 nt, Mus musculus
aggcaagaugcuggcauagcug

SEQ ID NO: 2225 - RNA, 21 nt, Mus musculus
uauugcacauuacuaaguugc

SEQ ID NO: 2226 - RNA, 23 nt, Mus musculus
aaaagcuggguugagagggcgaa

SEQ ID NO: 2227 - RNA, 20 nt, Mus musculus
aaacaugaagcgcugcaaca

SEQ ID NO: 2228 - RNA, 22 nt, Mus musculus
gcacauuacacggucgaccucu

SEQ ID NO: 2229 - RNA, 22 nt, Mus musculus
ccacugccccaggugcugcugg

SEQ ID NO: 2230 - RNA, 22 nt, Mus musculus
cgcauccccuagggcauuggug

SEQ ID NO: 2231 - RNA, 23 nt, Mus musculus
ccuaguaggugcucaguaagugu

SEQ ID NO: 2232 - RNA, 21 nt, Mus musculus
ccucugggcccuuccuccagu

SEQ ID NO: 2233 - RNA, 22 nt, Mus musculus
cuggcccucucugcccuuccgu

SEQ ID NO: 2234 - RNA, 22 nt, Mus musculus
aacacacccagcuaaccuuuuu

SEQ ID NO: 2235 - RNA, 19 nt, Mus musculus
gugcauuguaguugcauug

SEQ ID NO: 2236 - RNA, 23 nt, Mus musculus
gcaaagcacagggccugcagaga

SEQ ID NO: 2237 - RNA, 21 nt, Mus musculus
gccccugggccuauccuagaa

SEQ ID NO: 2238 - RNA, 23 nt, Mus musculus
ucaagagcaauaacgaaaaaugu

SEQ ID NO: 2239 - RNA, 23 nt, Mus musculus
uucagcuccuauaugaugccuuu

SEQ ID NO: 2240 - RNA, 23 nt, Mus musculus
uccagcaucagugauuuuguuga

SEQ ID NO: 2241 - RNA, 21 nt, Mus musculus
ucccuguccuccaggagcuca

SEQ ID NO: 2242 - RNA, 23 nt, Mus musculus
uccgucucaguuacuuuauagcc

SEQ ID NO: 2243 - RNA, 21 nt, Mus musculus
ucgaucggucggucggucagu

SEQ ID NO: 2244 - RNA, 24 nt, Mus musculus
ucucacacagaaaucgcacccguc

SEQ ID NO: 2245 - RNA, 23 nt, Mus musculus
ugaucuagccaaagccugacugu

SEQ ID NO: 2246 - RNA, 21 nt, Mus musculus
ugcugaccccuaguccagugc

SEQ ID NO: 2247 - RNA, 23 nt, Mus musculus
ugucugcccgagugccugccucu

SEQ ID NO: 2248 - RNA, 23 nt, Mus musculus
uggcagugucuuagcugguuguu

SEQ ID NO: 2249 - RNA, 23 nt, Mus musculus
uaggcaguguaauuagcugauug

SEQ ID NO: 2250 - RNA, 23 nt, Mus musculus
aggcaguguaguuagcugauugc

SEQ ID NO: 2251 - RNA, 23 nt, Mus musculus
uucacaaagcccauacacuuuca

SEQ ID NO: 2252 - RNA, 24 nt, Mus musculus
ucccugaggagcccuuugagccug

SEQ ID NO: 2253 - RNA, 22 nt, Mus musculus
uuaucagaaucuccagggguac

SEQ ID NO: 2254 - RNA, 23 nt, Mus musculus
aauccuuggaaccuaggugugaa

SEQ ID NO: 2255 - RNA, 22 nt, Mus musculus
auugcacgguauccaucuguaa

SEQ ID NO: 2256 - RNA, 22 nt, Mus musculus
uaaugccccuaaaaauccuuau

SEQ ID NO: 2257 - RNA, 21 nt, Mus musculus
aauugcacuuuagcaauggug

SEQ ID NO: 2258 - RNA, 20 nt, Mus musculus
aauaauacaugguugaucuu

SEQ ID NO: 2259 - RNA, 21 nt, Mus musculus
agaucgaccguguuauauucg

SEQ ID NO: 2260 - RNA, 23 nt, Mus musculus
gccugcugggguggaaccugguu

SEQ ID NO: 2261 - RNA, 22 nt, Mus musculus
gguuguauuaucauuguccgag

SEQ ID NO: 2262 - RNA, 22 nt, Mus musculus
auauaauacaaccugcuaagug

SEQ ID NO: 2263 - RNA, 22 nt, Mus musculus
uuuguucguucggcucgcguga

SEQ ID NO: 2264 - RNA, 21 nt, Mus musculus
aucguagaggaaaauccacgu

SEQ ID NO: 2265 - RNA, 21 nt, Mus musculus
gguagauucuccuucuaugag

SEQ ID NO: 2266 - RNA, 22 nt, Mus musculus
aucauagaggaacauccacuuu

SEQ ID NO: 2267 - RNA, 21 nt, Mus musculus
guggauauuccuucuaugguu

SEQ ID NO: 2268 - RNA, 20 nt, Mus musculus
aacauagaggaaauuucacg

SEQ ID NO: 2269 - RNA, 22 nt, Mus musculus
aucacacaaaggcaacuuuugu

SEQ ID NO: 2270 - RNA, 22 nt, Mus musculus
cuccugacuccagguccugugu

SEQ ID NO: 2271 - RNA, 21 nt, Mus musculus
ugguagacuauggaacguagg

SEQ ID NO: 2272 - RNA, 22 nt, Mus musculus
uauguaguaugguccacaucuu

SEQ ID NO: 2273 - RNA, 22 nt, Mus musculus
ugguugaccauagaacaugcgc

SEQ ID NO: 2274 - RNA, 22 nt, Mus musculus
uauacaagggcaagcucucugu

SEQ ID NO: 2275 - RNA, 22 nt, Mus musculus
gaaguuguucgugguggauucg

SEQ ID NO: 2276 - RNA, 22 nt, Mus musculus
agaucagaaggugacuguggcu

SEQ ID NO: 2277 - RNA, 20 nt, Mus musculus
auuccuagaaauuguucaca

SEQ ID NO: 2278 - RNA, 23 nt, Mus musculus
gaauguugcucggugaaccccuu

SEQ ID NO: 2279 - RNA, 22 nt, Mus musculus
aauauaacacagauggccuguu

SEQ ID NO: 2280 - RNA, 23 nt, Mus musculus
aacacgguccacuaacccucagu

SEQ ID NO: 2281 - RNA, 23 nt, Mus musculus
acuucaccugguccacuagccgu

SEQ ID NO: 2282 - RNA, 22 nt, Mus musculus
cuggacuuggagucagaaggcc

SEQ ID NO: 2283 - RNA, 22 nt, Mus musculus
agcucggucugaggccccucag

SEQ ID NO: 2284 - RNA, 22 nt, Mus musculus
cagcagcaauucauguuuugga

SEQ ID NO: 2285 - RNA, 21 nt, Mus musculus
aucgggaaugucguguccgcc

SEQ ID NO: 2286 - RNA, 22 nt, Mus musculus
uaauacugucugguaaugccgu

SEQ ID NO: 2287 - RNA, 23 nt, Mus musculus
ugucuugcaggccgucaugcagg

SEQ ID NO: 2288 - RNA, 22 nt, Mus musculus
aucaugaugggcuccucggugu

SEQ ID NO: 2289 - RNA, 22 nt, Mus musculus
uacggugagccugucauuauuc

SEQ ID NO: 2290 - RNA, 21 nt, Mus musculus
uuugaaccaucacucgacucc

SEQ ID NO: 2291 - RNA, 22 nt, Mus musculus
agcucgacucaugguuugaacc

SEQ ID NO: 2292 - RNA, 22 nt, Mus musculus
uugcauauguaggaugucccau

SEQ ID NO: 2293 - RNA, 22 nt, Mus musculus
uggcaguguauuguuagcuggu

SEQ ID NO: 2294 - RNA, 21 nt, Mus musculus
aggcagugcauugcuagcugg

SEQ ID NO: 2295 - RNA, 22 nt, Mus musculus
uuuuugcgauguguuccuaaua

SEQ ID NO: 2296 - RNA, 22 nt, Mus musculus
uuuugcaguauguuccugaaua

SEQ ID NO: 2297 - RNA, 22 nt, Mus musculus
auugggaacauuuugcaugcau

SEQ ID NO: 2298 - RNA, 22 nt, Mus musculus
aaaccguuaccauuacugaguu

SEQ ID NO: 2299 - RNA, 22 nt, Mus musculus
uguuugcagaggaaacugagac

SEQ ID NO: 2300 - RNA, 24 nt, Mus musculus
augcaguccacgggcauauacacu

SEQ ID NO: 2301 - RNA, 22 nt, Mus musculus
uaugugccuuuggacuacaucg

SEQ ID NO: 2302 - RNA, 21 nt, Mus musculus
uaccuaauuuguuguccauca

SEQ ID NO: 2303 - RNA, 23 nt, Mus musculus
uaccaaguuuauucugugagaua

SEQ ID NO: 2304 - RNA, 23 nt, Mus musculus
uauuuagaauggcacugauguga

SEQ ID NO: 2305 - RNA, 23 nt, Mus musculus
auacauacacgcacacauaagac

SEQ ID NO: 2306 - RNA, 21 nt, Mus musculus
guaagugccugcauguauaug

SEQ ID NO: 2307 - RNA, 22 nt, Mus musculus
auauacauacacacaccuacac

SEQ ID NO: 2308 - RNA, 22 nt, Mus musculus
auauacauacacacaccaacac

SEQ ID NO: 2309 - RNA, 23 nt, Mus musculus
uaugacugaugugcgugugucug

SEQ ID NO: 2310 - RNA, 26 nt, Mus musculus
ugccucuuucauugaucuuggugucc

SEQ ID NO: 2311 - RNA, 21 nt, Mus musculus
uucuuggacuggcacugguga

SEQ ID NO: 2312 - RNA, 23 nt, Mus musculus
uacguaguauagugcuuuucaca

SEQ ID NO: 2313 - RNA, 23 nt, Mus musculus
ucacuccuccccucccgucuugu

SEQ ID NO: 2314 - RNA, 22 nt, Mus musculus
ucaggcucaguccccucccgau

SEQ ID NO: 2315 - RNA, 22 nt, Mus musculus
agucauacacggcucuccucuc

SEQ ID NO: 2316 - RNA, 22 nt, Mus musculus
agaggcuggccgugaugaauuc

SEQ ID NO: 2317 - RNA, 22 nt, Mus musculus
uccuguacugagcugccccgag

SEQ ID NO: 2318 - RNA, 21 nt, Mus musculus
aaucguacagggucauccacu

SEQ ID NO: 2319 - RNA, 21 nt, Mus musculus
cccagauaauagcacucucaa

SEQ ID NO: 2320 - RNA, 21 nt, Mus musculus
uugaaaggcuguuucuugguc

SEQ ID NO: 2321 - RNA, 23 nt, Mus musculus
aaugacaccacauauauggcagc

SEQ ID NO: 2322 - RNA, 22 nt, Mus musculus
caaccuggaggacuccaugcug

SEQ ID NO: 2323 - RNA, 22 nt, Mus musculus
aguggggaacccuuccaugagg

SEQ ID NO: 2324 - RNA, 21 nt, Mus musculus
ugaaacauacacgggaaaccu

SEQ ID NO: 2325 - RNA, 22 nt, Mus musculus
aaacaaacauggugcacuucuu

SEQ ID NO: 2326 - RNA, 22 nt, Mus musculus
ugaguauuacauggccaaucuc

SEQ ID NO: 2327 - RNA, 22 nt, Mus musculus
cagcagcacacugugguuugua

SEQ ID NO: 2328 - RNA, 21 nt, Mus musculus
uuaagacuugcagugauguuu

SEQ ID NO: 2329 - RNA, 22 nt, Mus musculus
augcaccugggcaaggguucag

SEQ ID NO: 2330 - RNA, 22 nt, Mus musculus
aauccuuugucccugggugaaa

SEQ ID NO: 2331 - RNA, 22 nt, Mus musculus
aaugcacccgggcaaggauuug

SEQ ID NO: 2332 - RNA, 21 nt, Mus musculus
uagcagcgggaacaguacugc

SEQ ID NO: 2333 - RNA, 22 nt, Mus musculus
cgucaacacuugcugguuuucu

SEQ ID NO: 2334 - RNA, 22 nt, Mus musculus
caugccuugaguguaggaccgu

SEQ ID NO: 2335 - RNA, 22 nt, Mus musculus
ggagaaauuauccuuggugugu

SEQ ID NO: 2336 - RNA, 20 nt, Mus musculus
aggucagaggucgauccugg

SEQ ID NO: 2337 - RNA, 23 nt, Mus musculus
aagggauucugauguuggucaca

SEQ ID NO: 2338 - RNA, 22 nt, Mus musculus
ugugacagauugauaacugaaa

SEQ ID NO: 2339 - RNA, 21 nt, Mus musculus
cucggggaucaucaugucacg

SEQ ID NO: 2340 - RNA, 21 nt, Mus musculus
aaacauucgcggugcacuucu

SEQ ID NO: 2341 - RNA, 16 nt, Mus musculus
augguggcacggaguc

SEQ ID NO: 2342 - RNA, 20 nt, Mus musculus
cuugguacaucuuugaguga

SEQ ID NO: 2343 - RNA, 22 nt, Mus musculus
cgacccauacuugguuucagug

SEQ ID NO: 2344 - RNA, 23 nt, Mus musculus
auugugucaauaugcgaugaugu

SEQ ID NO: 2345 - RNA, 22 nt, Mus musculus
uccgagccugggucucccucuu

SEQ ID NO: 2346 - RNA, 23 nt, Mus musculus
aauggcgccacuaggguugugca

SEQ ID NO: 2347 - RNA, 22 nt, Mus musculus
accaggaggcugaggucccuua

SEQ ID NO: 2348 - RNA, 22 nt, Mus musculus
agcgggcacagcugugagagcc

SEQ ID NO: 2349 - RNA, 23 nt, Mus musculus
ugacaccugccacccagcccaag

SEQ ID NO: 2350 - RNA, 24 nt, Mus musculus
ugucacucggcucggcccacuacc

SEQ ID NO: 2351 - RNA, 22 nt, Mus musculus
aguugugugugcauguucaugu

SEQ ID NO: 2352 - RNA, 22 nt, Mus musculus
aguuuugugugcaugugcaugu

SEQ ID NO: 2353 - RNA, 22 nt, Mus musculus
auaguuguguguggaugugugu

SEQ ID NO: 2354 - RNA, 22 nt, Mus musculus
aucccugaguguauguggugaa

SEQ ID NO: 2355 - RNA, 24 nt, Mus musculus
aggaagcccuggaggggcuggagg

SEQ ID NO: 2356 - RNA, 22 nt, Mus musculus
ugagguugguguacugugugug

SEQ ID NO: 2357 - RNA, 22 nt, Mus musculus
cucacagcucugguccuuggag

SEQ ID NO: 2358 - RNA, 22 nt, Mus musculus
gcacugagaugggaguggugua

SEQ ID NO: 2359 - RNA, 22 nt, Mus musculus
cacagcucccaucucagaacaa

SEQ ID NO: 2360 - RNA, 22 nt, Mus musculus
cuguaugcccuaaccgcucagu

SEQ ID NO: 2361 - RNA, 22 nt, Mus musculus
uggugcggaaagggcccacagu

SEQ ID NO: 2362 - RNA, 21 nt, Mus musculus
ccguccugagguuguugagcu

SEQ ID NO: 2363 - RNA, 22 nt, Mus musculus
acucuacaaccuuaggacuugc

SEQ ID NO: 2364 - RNA, 22 nt, Mus musculus
uucagugaugauuagcuucuga

SEQ ID NO: 2365 - RNA, 22 nt, Mus musculus
gucucggugcaaggacuggagg

SEQ ID NO: 2366 - RNA, 22 nt, Mus musculus
ggacugugaggugacucuuggu

SEQ ID NO: 2367 - RNA, 21 nt, Mus musculus
gggcaucugcugacauggggg

SEQ ID NO: 2368 - RNA, 21 nt, Mus musculus
cagccucgcuggcaggcagcu

SEQ ID NO: 2369 - RNA, 21 nt, Mus musculus
cugcagucacagugaagucug

SEQ ID NO: 2370 - RNA, 21 nt, Mus musculus
ccugcuguaagcuguguccuc

SEQ ID NO: 2371 - RNA, 19 nt, Mus musculus
aguuuucccuucaagucaa

SEQ ID NO: 2372 - RNA, 21 nt, Mus musculus
ucaauggcugaggugaggcac

SEQ ID NO: 2373 - RNA, 22 nt, Mus musculus
auugcuucccagacggugaaga

SEQ ID NO: 2374 - RNA, 22 nt, Mus musculus
cuauccuggaaugcagcaauga

SEQ ID NO: 2375 - RNA, 20 nt, Mus musculus
ucgcaggcgacuacuuauuc

SEQ ID NO: 2376 - RNA, 21 nt, Mus musculus
cguccccgcucggcggggucc

SEQ ID NO: 2377 - RNA, 22 nt, Mus musculus
aaaggcuaggcucacaaccaaa

SEQ ID NO: 2378 - RNA, 22 nt, Mus musculus
auuccugaagagaggcagaaaa

SEQ ID NO: 2379 - RNA, 21 nt, Mus musculus
aucucuuugagcgccucacuc

SEQ ID NO: 2380 - RNA, 23 nt, Mus musculus
gcagcuuucagauguggcuguaa

SEQ ID NO: 2381 - RNA, 21 nt, Mus musculus
cagccacauccgaaaguuuuc

SEQ ID NO: 2382 - RNA, 19 nt, Mus musculus
cugaaaauguugccugaag

SEQ ID NO: 2383 - RNA, 22 nt, Mus musculus
agauugggcauaggugacugaa

SEQ ID NO: 2384 - RNA, 18 nt, Mus musculus
gcgugugcuugcuguggg

SEQ ID NO: 2385 - RNA, 21 nt, Mus musculus
aacauccugguccuguggaga

SEQ ID NO: 2386 - RNA, 19 nt, Mus musculus
cauucucguuuccuucccu

SEQ ID NO: 2387 - RNA, 20 nt, Mus musculus
aggcagugcgaccuggcucg

SEQ ID NO: 2388 - RNA, 22 nt, Mus musculus
uggaagacuagugauuuuguug

SEQ ID NO: 2389 - RNA, 21 nt, Mus musculus
cacgcgggaaccgaguccacc

SEQ ID NO: 2390 - RNA, 21 nt, Mus musculus
uuagccgcugaaauagaugga

SEQ ID NO: 2391 - RNA, 21 nt, Mus musculus
ugcccacccuuuaccccgcuc

SEQ ID NO: 2392 - RNA, 21 nt, Mus musculus
aaaaccuucagaaggaaagaa

SEQ ID NO: 2393 - RNA, 21 nt, Mus musculus
agacaugugcucugcuccuag

SEQ ID NO: 2394 - RNA, 20 nt, Mus musculus
ggugggagguggggugggca

SEQ ID NO: 2395 - RNA, 22 nt, Mus musculus
agagaaacccugucucaaaaaa

SEQ ID NO: 2396 - RNA, 21 nt, Mus musculus
cagucaugccgcuugccuacg

SEQ ID NO: 2397 - RNA, 21 nt, Mus musculus
caacuagacugugagcuucua

SEQ ID NO: 2398 - RNA, 19 nt, Mus musculus
ggaggcagaggcaggagga

SEQ ID NO: 2399 - RNA, 22 nt, Mus musculus
ccaagucuuggggagaguugag

SEQ ID NO: 2400 - RNA, 22 nt, Mus musculus
gggacccggggagagauguaag

SEQ ID NO: 2401 - RNA, 21 nt, Mus musculus
cuccuucacccgggcgguacc

SEQ ID NO: 2402 - RNA, 22 nt, Mus musculus
ugcgagucacccccggguguug

SEQ ID NO: 2403 - RNA, 19 nt, Mus musculus
ugcacugaaggcacacagc

SEQ ID NO: 2404 - RNA, 21 nt, Mus musculus
cgacgagggccggucggucgc

SEQ ID NO: 2405 - RNA, 21 nt, Mus musculus
cuccgugcacacccccgcgug

SEQ ID NO: 2406 - RNA, 22 nt, Mus musculus
cucagacagagauaccuucucu

SEQ ID NO: 2407 - RNA, 21 nt, Mus musculus
cuuccgcccggccgggugucg

SEQ ID NO: 2408 - RNA, 22 nt, Mus musculus
aucucggcuacagaaaaauguu

SEQ ID NO: 2409 - RNA, 18 nt, Mus musculus
aucucgcuggggccucca

SEQ ID NO: 2410 - RNA, 21 nt, Mus musculus
cagugcaauuaaaagggggaa

SEQ ID NO: 2411 - RNA, 21 nt, Mus musculus
ugcggggcuagggcuaacagc

SEQ ID NO: 2412 - RNA, 19 nt, Mus musculus
uuugugaccugguccacua

SEQ ID NO: 2413 - RNA, 22 nt, Mus musculus
gcagagugcaaacaauuuugac

SEQ ID NO: 2414 - RNA, 27 nt, Mus musculus
gaaauucggcucugggucuguggggag

SEQ ID NO: 2415 - RNA, 22 nt, Mus musculus
gcagcagggugaaacugacaca

SEQ ID NO: 2416 - RNA, 22 nt, Mus musculus
ggggcuggggccgggacagagc

SEQ ID NO: 2417 - RNA, 22 nt, Mus musculus
ccagcugggaagaaccaguggc

SEQ ID NO: 2418 - RNA, 22 nt, Mus musculus
aggaggccauaguggcaacugu

SEQ ID NO: 2419 - RNA, 19 nt, Mus musculus
ggugcucacauguccuccu

SEQ ID NO: 2420 - RNA, 22 nt, Mus musculus
cgugggccugacguggagcugg

SEQ ID NO: 2421 - RNA, 21 nt, Mus musculus
uggaagacuugugauuuuguu

SEQ ID NO: 2422 - RNA, 24 nt, Mus musculus
gauugcugugcgugcggaaucgac

SEQ ID NO: 2423 - RNA, 22 nt, Mus musculus
ucaguaacaaagauucauccuu

SEQ ID NO: 2424 - RNA, 22 nt, Mus musculus
ugugaguuguuccucaccugga

SEQ ID NO: 2425 - RNA, 20 nt, Mus musculus
gaauugaucaggacauaggg

SEQ ID NO: 2426 - RNA, 22 nt, Mus musculus
ucuuugguuaucuagcuguaug

SEQ ID NO: 2427 - RNA, 21 nt, Mus musculus
uaaagcuagauaaccgaaagu

SEQ ID NO: 2428 - RNA, 21 nt, Mus musculus
uauugcacuugucccggccug

SEQ ID NO: 2429 - RNA, 23 nt, Mus musculus
caaagugcuguucgugcagguag

SEQ ID NO: 2430 - RNA, 23 nt, Mus musculus
uuuggcacuagcacauuuuugcu

SEQ ID NO: 2431 - RNA, 22 nt, Mus musculus
ugagguaguaaguuguauuguu

SEQ ID NO: 2432 - RNA, 20 nt, Mus musculus
acccguagauccgaucuugu

SEQ ID NO: 2433 - RNA, 22 nt, Mus musculus
cacccguagaaccgaccuugcg

SEQ ID NO: 2434 - RNA, 22 nt, Macaca nemestrina
uacaguacugugauaacugaag

SEQ ID NO: 2435 - RNA, 23 nt, Macaca nemestrina
agcagcauuguacagggcuauga

SEQ ID NO: 2436 - RNA, 20 nt, Macaca nemestrina
ucaaaugcucagacuccugu

SEQ ID NO: 2437 - RNA, 24 nt, Macaca nemestrina
aaaagugcuuacagugcagguagc

SEQ ID NO: 2438 - RNA, 21 nt, Macaca nemestrina
uaaagugcugacagugcagau

SEQ ID NO: 2439 - RNA, 23 nt, Macaca nemestrina
agcagcauuguacagggcuauca

SEQ ID NO: 2440 - RNA, 22 nt, Macaca nemestrina
uacccuguagaaccgaauuugu

SEQ ID NO: 2441 - RNA, 22 nt, Macaca nemestrina
ucccugagacccuaacuuguga

SEQ ID NO: 2442 - RNA, 22 nt, Macaca nemestrina
ucggauccgucugagcuuggcu

SEQ ID NO: 2443 - RNA, 20 nt, Macaca nemestrina
cagugcaauguuaaaagggc

SEQ ID NO: 2444 - RNA, 22 nt, Macaca nemestrina
uugguccccuucaaccagcugu

SEQ ID NO: 2445 - RNA, 21 nt, Macaca nemestrina
ugugacugguugaccagaggg

SEQ ID NO: 2446 - RNA, 21 nt, Macaca nemestrina
agugguucuacccuaugguag

SEQ ID NO: 2447 - RNA, 22 nt, Macaca nemestrina
uacaguauagaugauguacuag

SEQ ID NO: 2448 - RNA, 24 nt, Macaca nemestrina
guccaguuuucccaggaaucccuu

SEQ ID NO: 2449 - RNA, 20 nt, Macaca nemestrina
guguguggaaaugcuucugc

SEQ ID NO: 2450 - RNA, 20 nt, Macaca nemestrina
uugcauagucacaaaaguga

SEQ ID NO: 2451 - RNA, 22 nt, Macaca nemestrina
uagguuauccguguugccuucg

SEQ ID NO: 2452 - RNA, 22 nt, Macaca nemestrina
uagcagcacauaaugguuugug

SEQ ID NO: 2453 - RNA, 22 nt, Macaca nemestrina
uagcagcacaucaugguuuaca

SEQ ID NO: 2454 - RNA, 22 nt, Macaca nemestrina
uagcagcacguaaauauuggcg

SEQ ID NO: 2455 - RNA, 20 nt, Macaca nemestrina
acugcagugaaggcacuugu

SEQ ID NO: 2456 - RNA, 24 nt, Macaca nemestrina
caaagugcuuacagugcagguagu

SEQ ID NO: 2457 - RNA, 22 nt, Macaca nemestrina
uaaggugcaucuagugcagaua

SEQ ID NO: 2458 - RNA, 23 nt, Macaca nemestrina
aacauucaacgcugucggugagu

SEQ ID NO: 2459 - RNA, 22 nt, Macaca nemestrina
accaucgaccguugauuguacc

SEQ ID NO: 2460 - RNA, 24 nt, Macaca nemestrina
aacauucauugcugucgguggguu

SEQ ID NO: 2461 - RNA, 23 nt, Macaca nemestrina
uauggcacugguagaauucacug

SEQ ID NO: 2462 - RNA, 22 nt, Macaca nemestrina
uggacggagaacugauaagggu

SEQ ID NO: 2463 - RNA, 21 nt, Macaca nemestrina
ucgugucuuguguugcagccg

SEQ ID NO: 2464 - RNA, 22 nt, Macaca nemestrina
caucccuugcaugguggagggu

SEQ ID NO: 2465 - RNA, 23 nt, Macaca nemestrina
gugccuacugagcugauaucagu

SEQ ID NO: 2466 - RNA, 22 nt, Macaca nemestrina
uguaacagcaacuccaugugga

SEQ ID NO: 2467 - RNA, 22 nt, Macaca nemestrina
uucaccaccuucuccacccggc

SEQ ID NO: 2468 - RNA, 19 nt, Macaca nemestrina
gguccagaggggaaauagg

SEQ ID NO: 2469 - RNA, 23 nt, Macaca nemestrina
cccaguguucagacuaccuguuc

SEQ ID NO: 2470 - RNA, 23 nt, Macaca nemestrina
ugugcaaaucuaugcaaaacuga

SEQ ID NO: 2471 - RNA, 23 nt, Macaca nemestrina
ugugcaaauccaugcaaaacuga

SEQ ID NO: 2472 - RNA, 22 nt, Macaca nemestrina
uaaagugcuuauagugcaggua

SEQ ID NO: 2473 - RNA, 22 nt, Macaca nemestrina
uucccuuugucauccuaugccu

SEQ ID NO: 2474 - RNA, 22 nt, Macaca nemestrina
uccuucauuccaccggagucug

SEQ ID NO: 2475 - RNA, 22 nt, Macaca nemestrina
uggaauguaaggaagugugugg

SEQ ID NO: 2476 - RNA, 22 nt, Macaca nemestrina
uagcuuaucagacugauguuga

SEQ ID NO: 2477 - RNA, 22 nt, Macaca nemestrina
uucccuuugucauccuucgccu

SEQ ID NO: 2478 - RNA, 21 nt, Macaca nemestrina
acagcaggcacagacaggcag

SEQ ID NO: 2479 - RNA, 21 nt, Macaca nemestrina
augaccuaugaauugacagac

SEQ ID NO: 2480 - RNA, 21 nt, Macaca nemestrina
uugugcuugaucuaaccaugu

SEQ ID NO: 2481 - RNA, 22 nt, Macaca nemestrina
aagcugccaguugaagaacugu

SEQ ID NO: 2482 - RNA, 22 nt, Macaca nemestrina
ccaccaccaugucugacacuuu

SEQ ID NO: 2483 - RNA, 23 nt, Macaca nemestrina
caagucacuagugguuccguuua

SEQ ID NO: 2484 - RNA, 21 nt, Macaca nemestrina
aucacauugccagggauuucc

SEQ ID NO: 2485 - RNA, 22 nt, Macaca nemestrina
uggcucaguucagcaggaacag

SEQ ID NO: 2486 - RNA, 22 nt, Macaca nemestrina
cauugcacuugucucggucuga

SEQ ID NO: 2487 - RNA, 22 nt, Macaca nemestrina
uucaaguaauccaggauaggcu

SEQ ID NO: 2488 - RNA, 22 nt, Macaca nemestrina
uucacaguggcuaaguuccgcc

SEQ ID NO: 2489 - RNA, 22 nt, Macaca nemestrina
aaggagcucacagucuauugag

SEQ ID NO: 2490 - RNA, 22 nt, Macaca nemestrina
cuagcaccaucugaaaucgguu

SEQ ID NO: 2491 - RNA, 20 nt, Macaca nemestrina
uagcaccauuugaaaucagu

SEQ ID NO: 2492 - RNA, 21 nt, Macaca nemestrina
uguaaacauccuacacucagc

SEQ ID NO: 2493 - RNA, 23 nt, Macaca nemestrina
uguaaacauccuacacucucagc

SEQ ID NO: 2494 - RNA, 22 nt, Macaca nemestrina
uguaaacauccccgacuggaag

SEQ ID NO: 2495 - RNA, 21 nt, Macaca nemestrina
ggcaagaugcuggcauagcug

SEQ ID NO: 2496 - RNA, 21 nt, Macaca nemestrina
uauugcacauuacuaaguugc

SEQ ID NO: 2497 - RNA, 19 nt, Macaca nemestrina
gugcauuguaguugcauug

SEQ ID NO: 2498 - RNA, 22 nt, Macaca nemestrina
uggcagugucuuagcugguugu

SEQ ID NO: 2499 - RNA, 21 nt, Macaca nemestrina
uggaagacuagugauuuuguu

SEQ ID NO: 2500 - RNA, 23 nt, Macaca nemestrina
ucuuugguuaucuagcuguauga

SEQ ID NO: 2501 - RNA, 22 nt, Macaca nemestrina
uauugcacuugucccggccugu

SEQ ID NO: 2502 - RNA, 22 nt, Macaca nemestrina
aaagugcuguucgugcagguag

SEQ ID NO: 2503 - RNA, 22 nt, Macaca nemestrina
uuuggcacuagcacauuuuugc

SEQ ID NO: 2504 - RNA, 22 nt, Macaca nemestrina
aacccguagauccgaucuugug

SEQ ID NO: 2505 - RNA, 21 nt, Medicago truncatula
ugacagaagagagagagcaca

SEQ ID NO: 2506 - RNA, 21 nt, Medicago truncatula
ugccuggcucccuguaugcca

SEQ ID NO: 2507 - RNA, 21 nt, Medicago truncatula
ucgauaaaccucugcauccag

SEQ ID NO: 2508 - RNA, 21 nt, Medicago truncatula
ucggaccaggcuucauucccc

SEQ ID NO: 2509 - RNA, 21 nt, Medicago truncatula
cagccaaggaugacuugccga

SEQ ID NO: 2510 - RNA, 21 nt, Medicago truncatula
cagccaaggaugacuugccga

SEQ ID NO: 2511 - RNA, 21 nt, Medicago truncatula
ugauugagucgugccaauauc

SEQ ID NO: 2512 - RNA, 20 nt, Medicago truncatula
uuggacugaagggagcuccc

SEQ ID NO: 2513 - RNA, 21 nt, Medicago truncatula
uccaaagggaucgcauugauc

SEQ ID NO: 2514 - RNA, 21 nt, Medicago truncatula
augaaguguuugggggaacuc

SEQ ID NO: 2515 - RNA, 21 nt, Medicago truncatula
augaaguauuugggggaacuc

SEQ ID NO: 2516 - RNA, 21 nt, Medicago truncatula
augaaguguuugggggaacuc

SEQ ID NO: 2517 - RNA, 21 nt, Medicago truncatula
augaaguguuugggggaacuc

SEQ ID NO: 2518 - RNA, 21 nt, Medicago truncatula
augaaguguuugggggaacuc

SEQ ID NO: 2519 - RNA, 21 nt, Medicago truncatula
augaaguguuugggggaacuc

SEQ ID NO: 2520 - RNA, 21 nt, Medicago truncatula
uugaaguguuugggggaacuc

SEQ ID NO: 2521 - RNA, 21 nt, Medicago truncatula
augaaguguuugggggaacuu

SEQ ID NO: 2522 - RNA, 21 nt, Medicago truncatula
augaaguguuugggggaacuc

SEQ ID NO: 2523 - RNA, 21 nt, Medicago truncatula
augaaguguuugggggaacuc

SEQ ID NO: 2524 - RNA, 21 nt, Medicago truncatula
augaaguguuugggggaacuc

SEQ ID NO: 2525 - RNA, 21 nt, Medicago truncatula
augaaguguuugggggaacuc

SEQ ID NO: 2526 - RNA, 21 nt, Medicago truncatula
augaaguguuugggggaacuc

SEQ ID NO: 2527 - RNA, 21 nt, Medicago truncatula
augaaguguuugggggaacuc

SEQ ID NO: 2528 - RNA, 21 nt, Medicago truncatula
augaaguguuugggggaacuc

SEQ ID NO: 2529 - RNA, 21 nt, Medicago truncatula
uugaagcguuugggggaacuc

SEQ ID NO: 2530 - RNA, 21 nt, Medicago truncatula
ugccaaaggagauuugcccag

SEQ ID NO: 2531 - RNA, 21 nt, Medicago truncatula
ugccaaaggagagcugcccug

SEQ ID NO: 2532 - RNA, 21 nt, Medicago truncatula
ugccaaaggagauuugcccug

SEQ ID NO: 2533 - RNA, 21 nt, Medicago truncatula
ugccaaaggagagcugcccua

SEQ ID NO: 2534 - RNA, 21 nt, Medicago truncatula
ugccaaaggagauuugcccag

SEQ ID NO: 2535 - RNA, 23 nt, Ovis aries
aucggauccgucugagcuuggcu

SEQ ID NO: 2536 - RNA, 23 nt, Ovis aries
acuccauuuguuuugaugaugga

SEQ ID NO: 2537 - RNA, 23 nt, Ovis aries
ugucuugcaggccgucaugcagg

SEQ ID NO: 2538 - RNA, 23 nt, Ovis aries
ucuuggaguaggucauugggugg

SEQ ID NO: 2539 - RNA, 20 nt, Oryza sativa
ugacagaagagagugagcac

SEQ ID NO: 2540 - RNA, 20 nt, Oryza sativa
ugacagaagagagugagcac

SEQ ID NO: 2541 - RNA, 20 nt, Oryza sativa
ugacagaagagagugagcac

SEQ ID NO: 2542 - RNA, 20 nt, Oryza sativa
ugacagaagagagugagcac

SEQ ID NO: 2543 - RNA, 20 nt, Oryza sativa
ugacagaagagagugagcac

SEQ ID NO: 2544 - RNA, 20 nt, Oryza sativa
ugacagaagagagugagcac

SEQ ID NO: 2545 - RNA, 20 nt, Oryza sativa
ugacagaagagagugagcac

SEQ ID NO: 2546 - RNA, 20 nt, Oryza sativa
ugacagaagagagugagcac

SEQ ID NO: 2547 - RNA, 20 nt, Oryza sativa
ugacagaagagagugagcac

SEQ ID NO: 2548 - RNA, 20 nt, Oryza sativa
ugacagaagagagugagcac

SEQ ID NO: 2549 - RNA, 21 nt, Oryza sativa
ugacagaagagagagagcaca

SEQ ID NO: 2550 - RNA, 21 nt, Oryza sativa
cgacagaagagagugagcaua

SEQ ID NO: 2551 - RNA, 21 nt, Oryza sativa
uuuggauugaagggagcucug

SEQ ID NO: 2552 - RNA, 21 nt, Oryza sativa
uuuggauugaagggagcucug

SEQ ID NO: 2553 - RNA, 21 nt, Oryza sativa
auuggauugaagggagcucca

SEQ ID NO: 2554 - RNA, 21 nt, Oryza sativa
auuggauugaagggagcuccg

SEQ ID NO: 2555 - RNA, 21 nt, Oryza sativa
auuggauugaagggagcuccu

SEQ ID NO: 2556 - RNA, 21 nt, Oryza sativa
cuuggauugaagggagcucua

SEQ ID NO: 2557 - RNA, 21 nt, Oryza sativa
ugccuggcucccuguaugcca

SEQ ID NO: 2558 - RNA, 21 nt, Oryza sativa
ugccuggcucccuguaugcca

SEQ ID NO: 2559 - RNA, 21 nt, Oryza sativa
ugccuggcucccuguaugcca

SEQ ID NO: 2560 - RNA, 21 nt, Oryza sativa
ugccuggcucccuguaugcca

SEQ ID NO: 2561 - RNA, 21 nt, Oryza sativa
ugccuggcucccuguaugccg

SEQ ID NO: 2562 - RNA, 21 nt, Oryza sativa
ugccuggcucccugaaugcca

SEQ ID NO: 2563 - RNA, 21 nt, Oryza sativa
ucgauaaaccucugcauccag

SEQ ID NO: 2564 - RNA, 21 nt, Oryza sativa
ucgauaagccucugcauccag

SEQ ID NO: 2565 - RNA, 21 nt, Oryza sativa
uggagaagcagggcacgugca

SEQ ID NO: 2566 - RNA, 21 nt, Oryza sativa
uggagaagcagggcacgugca

SEQ ID NO: 2567 - RNA, 21 nt, Oryza sativa
uggagaagcaggguacgugca

SEQ ID NO: 2568 - RNA, 21 nt, Oryza sativa
uggagaagcagggcacgugcu

SEQ ID NO: 2569 - RNA, 21 nt, Oryza sativa
uggagaagcagggcacgugag

SEQ ID NO: 2570 - RNA, 21 nt, Oryza sativa
uggagaagcagggcacgugca

SEQ ID NO: 2571 - RNA, 21 nt, Oryza sativa
ucggaccaggcuucauucccc

SEQ ID NO: 2572 - RNA, 21 nt, Oryza sativa
ucggaccaggcuucauucccc

SEQ ID NO: 2573 - RNA, 21 nt, Oryza sativa
ucggaccaggcuucauucccc

SEQ ID NO: 2574 - RNA, 21 nt, Oryza sativa
ucggaccaggcuucauucccc

SEQ ID NO: 2575 - RNA, 21 nt, Oryza sativa
ucgaaccaggcuucauucccc

SEQ ID NO: 2576 - RNA, 21 nt, Oryza sativa
ucggaccaggcuucauucccc

SEQ ID NO: 2577 - RNA, 21 nt, Oryza sativa
ucggaccaggcuucauuccuc

SEQ ID NO: 2578 - RNA, 21 nt, Oryza sativa
ucggaccaggcuucauuccuc

SEQ ID NO: 2579 - RNA, 21 nt, Oryza sativa
ucggaucaggcuucauuccuc

SEQ ID NO: 2580 - RNA, 21 nt, Oryza sativa
ucggaucaggcuucauuccuc

SEQ ID NO: 2581 - RNA, 21 nt, Oryza sativa
ucggaccaggcuucaaucccu

SEQ ID NO: 2582 - RNA, 21 nt, Oryza sativa
ucggaccaggcuucaaucccu

SEQ ID NO: 2583 - RNA, 21 nt, Oryza sativa
ucggaccaggcuucauucccu

SEQ ID NO: 2584 - RNA, 21 nt, Oryza sativa
ucggaccaggcuucauucccc

SEQ ID NO: 2585 - RNA, 21 nt, Oryza sativa
ugaagcugccagcaugaucua

SEQ ID NO: 2586 - RNA, 21 nt, Oryza sativa
ugaagcugccagcaugaucua

SEQ ID NO: 2587 - RNA, 21 nt, Oryza sativa
ugaagcugccagcaugaucua

SEQ ID NO: 2588 - RNA, 21 nt, Oryza sativa
ugaagcugccagcaugaucug

SEQ ID NO: 2589 - RNA, 21 nt, Oryza sativa
ugaagcugccagcaugaucug

SEQ ID NO: 2590 - RNA, 21 nt, Oryza sativa
ugaagcugccagcaugaucug

SEQ ID NO: 2591 - RNA, 21 nt, Oryza sativa
ugaagcugccagcaugaucug

SEQ ID NO: 2592 - RNA, 21 nt, Oryza sativa
ugaagcugccagcaugaucug

SEQ ID NO: 2593 - RNA, 21 nt, Oryza sativa
ugaagcugccagcaugaucug

SEQ ID NO: 2594 - RNA, 21 nt, Oryza sativa
ugaagcugccagcaugaucug

SEQ ID NO: 2595 - RNA, 21 nt, Oryza sativa
ucgcuuggugcagaucgggac

SEQ ID NO: 2596 - RNA, 21 nt, Oryza sativa
aggcuuggugcagcucgggaa

SEQ ID NO: 2597 - RNA, 21 nt, Oryza sativa
cagccaaggaugacuugccga

SEQ ID NO: 2598 - RNA, 21 nt, Oryza sativa
cagccaaggaugacuugccgg

SEQ ID NO: 2599 - RNA, 21 nt, Oryza sativa
cagccaaggaugacuugccgg

SEQ ID NO: 2600 - RNA, 21 nt, Oryza sativa
uagccaaggaugaauugccgg

SEQ ID NO: 2601 - RNA, 21 nt, Oryza sativa
uagccaaggaugacuugccgg

SEQ ID NO: 2602 - RNA, 21 nt, Oryza sativa
uagccaaggaugacuugccua

SEQ ID NO: 2603 - RNA, 21 nt, Oryza sativa
uagccaaggaugacuugccua

SEQ ID NO: 2604 - RNA, 21 nt, Oryza sativa
uagccaaggaugacuugccug

SEQ ID NO: 2605 - RNA, 21 nt, Oryza sativa
uagccaaggaugacuugccug

SEQ ID NO: 2606 - RNA, 21 nt, Oryza sativa
uagccaaggaugacuugccug

SEQ ID NO: 2607 - RNA, 21 nt, Oryza sativa
uagccaaggaugacuugccug

SEQ ID NO: 2608 - RNA, 21 nt, Oryza sativa
uagccaaggaugacuugccug

SEQ ID NO: 2609 - RNA, 21 nt, Oryza sativa
uagccaaggaugacuugccug

SEQ ID NO: 2610 - RNA, 21 nt, Oryza sativa
uagccaagaaugacuugccua

SEQ ID NO: 2611 - RNA, 21 nt, Oryza sativa
uagccaagaaugacuugccua

SEQ ID NO: 2612 - RNA, 22 nt, Oryza sativa
uagccaaggacaaacuugccgg

SEQ ID NO: 2613 - RNA, 21 nt, Oryza sativa
uagccaaggagacugcccaug

SEQ ID NO: 2614 - RNA, 21 nt, Oryza sativa
ugauugagccgcgccaauauc

SEQ ID NO: 2615 - RNA, 21 nt, Oryza sativa
ugauugagccgugccaauauc

SEQ ID NO: 2616 - RNA, 21 nt, Oryza sativa
ugauugagccgugccaauauc

SEQ ID NO: 2617 - RNA, 21 nt, Oryza sativa
ugauugagccgugccaauauc

SEQ ID NO: 2618 - RNA, 21 nt, Oryza sativa
ugauugagccgugccaauauc

SEQ ID NO: 2619 - RNA, 21 nt, Oryza sativa
ugauugagccgugccaauauc

SEQ ID NO: 2620 - RNA, 21 nt, Oryza sativa
gaggugagccgagccaauauc

SEQ ID NO: 2621 - RNA, 21 nt, Oryza sativa
gugagccgaaccaauaucacu

SEQ ID NO: 2622 - RNA, 21 nt, Oryza sativa
ggauugagccgcgucaauauc

SEQ ID NO: 2623 - RNA, 21 nt, Oryza sativa
agaaucuugaugaugcugcau

SEQ ID NO: 2624 - RNA, 21 nt, Oryza sativa
ggaaucuugaugaugcugcau

SEQ ID NO: 2625 - RNA, 21 nt, Oryza sativa
ugaaucuugaugaugcugcac

SEQ ID NO: 2626 - RNA, 21 nt, Oryza sativa
agaaucuugaugaugcugcau

SEQ ID NO: 2627 - RNA, 20 nt, Oryza sativa
uuggacugaagggugcuccc

SEQ ID NO: 2628 - RNA, 20 nt, Oryza sativa
uuggacugaagggugcuccc

SEQ ID NO: 2629 - RNA, 21 nt, Oryza sativa
aagcucaggagggauagcgcc

SEQ ID NO: 2630 - RNA, 21 nt, Oryza sativa
uccaaagggaucgcauugauc

SEQ ID NO: 2631 - RNA, 22 nt, Oryza sativa
uccaaagggaucgcauugaucu

SEQ ID NO: 2632 - RNA, 20 nt, Oryza sativa
uuggcauucuguccaccucc

SEQ ID NO: 2633 - RNA, 21 nt, Oryza sativa
gugaagugcuugggggaacuc

SEQ ID NO: 2634 - RNA, 21 nt, Oryza sativa
gugaaguguuugggggaacuc

SEQ ID NO: 2635 - RNA, 21 nt, Oryza sativa
gugaaguguuuggaggaacuc

SEQ ID NO: 2636 - RNA, 21 nt, Oryza sativa
gugaaguguuugggggaacuc

SEQ ID NO: 2637 - RNA, 21 nt, Oryza sativa
gugaaguguuugggggaacuc

SEQ ID NO: 2638 - RNA, 21 nt, Oryza sativa
gugaauuguuugggggaacuc

SEQ ID NO: 2639 - RNA, 21 nt, Oryza sativa
gugaaguguuugggggaacuc

SEQ ID NO: 2640 - RNA, 21 nt, Oryza sativa
gugaaguguuugggggaacuc

SEQ ID NO: 2641 - RNA, 21 nt, Oryza sativa
gugaaguguuugggggaacuc

SEQ ID NO: 2642 - RNA, 21 nt, Oryza sativa
gugaaguguuugggggaacuc

SEQ ID NO: 2643 - RNA, 21 nt, Oryza sativa
gugaaguguuugggggaacuc

SEQ ID NO: 2644 - RNA, 21 nt, Oryza sativa
gugaaguguuugggggaacuc

SEQ ID NO: 2645 - RNA, 21 nt, Oryza sativa
gugaaguguuugggggaacuc

SEQ ID NO: 2646 - RNA, 21 nt, Oryza sativa
gugaaguguuugggggaacuc

SEQ ID NO: 2647 - RNA, 21 nt, Oryza sativa
augaaguguuuggaggaacuc

SEQ ID NO: 2648 - RNA, 21 nt, Oryza sativa
gugaaguguuugggggaacuc

SEQ ID NO: 2649 - RNA, 21 nt, Oryza sativa
gugaaguguuugggggaacuc

SEQ ID NO: 2650 - RNA, 21 nt, Oryza sativa
gugaaguguuugggggaacuc

SEQ ID NO: 2651 - RNA, 21 nt, Oryza sativa
gugaaguguuugggggaacuc

SEQ ID NO: 2652 - RNA, 21 nt, Oryza sativa
gugaaguguuuggggaaacuc

SEQ ID NO: 2653 - RNA, 21 nt, Oryza sativa
gugaagcguuugggggaaauc

SEQ ID NO: 2654 - RNA, 21 nt, Oryza sativa
gugaaguauuuggcggaacuc

SEQ ID NO: 2655 - RNA, 22 nt, Oryza sativa
gugaaguguuugggggauucuc

SEQ ID NO: 2656 - RNA, 21 nt, Oryza sativa
uuccacagcuuucuugaacug

SEQ ID NO: 2657 - RNA, 21 nt, Oryza sativa
uuccacagcuuucuugaacug

SEQ ID NO: 2658 - RNA, 21 nt, Oryza sativa
uuccacagcuuucuugaacuu

SEQ ID NO: 2659 - RNA, 21 nt, Oryza sativa
uccacaggcuuucuugaacug

SEQ ID NO: 2660 - RNA, 21 nt, Oryza sativa
uccacaggcuuucuugaacug

SEQ ID NO: 2661 - RNA, 21 nt, Oryza sativa
ucauugagugcagcguugaug

SEQ ID NO: 2662 - RNA, 21 nt, Oryza sativa
uuauugagugcagcguugaug

SEQ ID NO: 2663 - RNA, 21 nt, Oryza sativa
uguguucucaggucaccccuu

SEQ ID NO: 2664 - RNA, 21 nt, Oryza sativa
uguguucucaggucgccccug

SEQ ID NO: 2665 - RNA, 21 nt, Oryza sativa
ugccaaaggagaauugcccug

SEQ ID NO: 2666 - RNA, 21 nt, Oryza sativa
ugccaaaggagaauugcccug

SEQ ID NO: 2667 - RNA, 21 nt, Oryza sativa
ugccaaaggagaauugcccug

SEQ ID NO: 2668 - RNA, 21 nt, Oryza sativa
ugccaaaggagaguugcccug

SEQ ID NO: 2669 - RNA, 21 nt, Oryza sativa
ugccaaaggagauuugcccag

SEQ ID NO: 2670 - RNA, 21 nt, Oryza sativa
ugccaaaggagauuugcccag

SEQ ID NO: 2671 - RNA, 21 nt, Oryza sativa
ugccaaaggagauuugcccag

SEQ ID NO: 2672 - RNA, 21 nt, Oryza sativa
ugccaaaggagacuugcccag

SEQ ID NO: 2673 - RNA, 21 nt, Oryza sativa
ugccaaaggagagcugcccug

SEQ ID NO: 2674 - RNA, 21 nt, Oryza sativa
ugccaaaggagaguugcccua

SEQ ID NO: 2675 - RNA, 21 nt, Oryza sativa
ugccaaaggaaauuugccccg

SEQ ID NO: 2676 - RNA, 21 nt, Oryza sativa
cugcacugccucuucccuggc

SEQ ID NO: 2677 - RNA, 21 nt, Oryza sativa
cuaguuucacuuguucugcac

SEQ ID NO: 2678 - RNA, 21 nt, Oryza sativa
ucauccucaucaucaucgucc

SEQ ID NO: 2679 - RNA, 21 nt, Oryza sativa
aacagaacagaagcagagcag

SEQ ID NO: 2680 - RNA, 21 nt, Oryza sativa
uguucguccguacacuguuca

SEQ ID NO: 2681 - RNA, 21 nt, Oryza sativa
gaauguagugaauuuguucca

SEQ ID NO: 2682 - RNA, 21 nt, Oryza sativa
uaaugugaugaugaaaugacg

SEQ ID NO: 2683 - RNA, 21 nt, Oryza sativa
ugaugaaugcugacgauguug

SEQ ID NO: 2684 - RNA, 21 nt, Oryza sativa
uaaauuaaucacggaaaugau

SEQ ID NO: 2685 - RNA, 21 nt, Oryza sativa
uuuuggaaguuuguccuuacg

SEQ ID NO: 2686 - RNA, 20 nt, Oryza sativa
uuauccgguauuggaguuga

SEQ ID NO: 2687 - RNA, 21 nt, Oryza sativa
aaaguuagagaaguuugacuu

SEQ ID NO: 2688 - RNA, 21 nt, Oryza sativa
uucccacgcguuauagugaaa

SEQ ID NO: 2689 - RNA, 21 nt, Oryza sativa
ugucgaaccgcgguuguucga

SEQ ID NO: 2690 - RNA, 21 nt, Oryza sativa
ugucgaaccgcgguuguucga

SEQ ID NO: 2691 - RNA, 21 nt, Oryza sativa
ugucgaaccgcgguuguucga

SEQ ID NO: 2692 - RNA, 21 nt, Oryza sativa
ugucgaaccgcgguuguucga

SEQ ID NO: 2693 - RNA, 21 nt, Oryza sativa
ugucgaaccgcgguuguucga

SEQ ID NO: 2694 - RNA, 21 nt, Oryza sativa
ugucgaaccgcgguuguucga

SEQ ID NO: 2695 - RNA, 21 nt, Oryza sativa
ugucgaaccgcgguuguucga

SEQ ID NO: 2696 - RNA, 21 nt, Oryza sativa
ugucgaaccgcgguuguucga

SEQ ID NO: 2697 - RNA, 21 nt, Oryza sativa
ugucgaaccgcgguuguucga

SEQ ID NO: 2698 - RNA, 21 nt, Oryza sativa
ugucgaaccgcgguuguucga

SEQ ID NO: 2699 - RNA, 24 nt, Oryza sativa
agugucuccugaugaucgggacaa

SEQ ID NO: 2700 - RNA, 24 nt, Oryza sativa
uaccaucaauauaaaugugggaaa

SEQ ID NO: 2701 - RNA, 24 nt, Oryza sativa
uaccaucaauauaaaugugggaaa

SEQ ID NO: 2702 - RNA, 24 nt, Oryza sativa
uaccaucaauauaaaugugggaaa

SEQ ID NO: 2703 - RNA, 24 nt, Oryza sativa
ugacguguaaauugcgagacgaau

SEQ ID NO: 2704 - RNA, 22 nt, Oryza sativa
aucacaauacaauaaaucugga

SEQ ID NO: 2705 - RNA, 21 nt, Oryza sativa
uugcugccucaagcuugcugc

SEQ ID NO: 2706 - RNA, 24 nt, Oryza sativa
uaaauuaguguauaaacauccgau

SEQ ID NO: 2707 - RNA, 24 nt, Oryza sativa
uaaauuaguguauaaacauccgau

SEQ ID NO: 2708 - RNA, 24 nt, Oryza sativa
uaaauuaguguauaaacauccgau

SEQ ID NO: 2709 - RNA, 24 nt, Oryza sativa
uaaauuaguguauaaacauccgau

SEQ ID NO: 2710 - RNA, 24 nt, Oryza sativa
uaaauuaguguauaaacauccgau

SEQ ID NO: 2711 - RNA, 24 nt, Oryza sativa
uaaauuaguguauaaacauccgau

SEQ ID NO: 2712 - RNA, 24 nt, Oryza sativa
uaaauuaguguauaaacauccgau

SEQ ID NO: 2713 - RNA, 24 nt, Oryza sativa
uaaauuaguguauaaacauccgau

SEQ ID NO: 2714 - RNA, 24 nt, Oryza sativa
uaaauuaguguauaaacauccgau

SEQ ID NO: 2715 - RNA, 24 nt, Oryza sativa
caucaauaugaauaugggaaaugg

SEQ ID NO: 2716 - RNA, 21 nt, Oryza sativa
uggaaggggcaugcagaggag

SEQ ID NO: 2717 - RNA, 20 nt, Oryza sativa
cuguacccucucucuucuuc

SEQ ID NO: 2718 - RNA, 21 nt, Oryza sativa
aggugcagaggcagaugcaac

SEQ ID NO: 2719 - RNA, 24 nt, Oryza sativa
cucgccggggcugcgugccgccau

SEQ ID NO: 2720 - RNA, 21 nt, Oryza sativa
ugacaacgagagagagcacgc

SEQ ID NO: 2721 - RNA, 22 nt, Oryza sativa
augugcuaaaaagucaacggug

SEQ ID NO: 2722 - RNA, 22 nt, Oryza sativa
augugcuaaaaagucaacggug

SEQ ID NO: 2723 - RNA, 22 nt, Oryza sativa
augugcuaaaaagucaacggug

SEQ ID NO: 2724 - RNA, 22 nt, Oryza sativa
augugcuaaaaagucaacggug

SEQ ID NO: 2725 - RNA, 22 nt, Oryza sativa
augugcuaaaaagucaacggug

SEQ ID NO: 2726 - RNA, 22 nt, Oryza sativa
augugcuaaaaagucaacggug

SEQ ID NO: 2727 - RNA, 22 nt, Oryza sativa
augugcuaaaaagucaacggug

SEQ ID NO: 2728 - RNA, 22 nt, Oryza sativa
augugcuaaaaagucaacggug

SEQ ID NO: 2729 - RNA, 21 nt, Oryza sativa
cgucaucucacaggugaaucc

SEQ ID NO: 2730 - RNA, 21 nt, Oryza sativa
cgucaucucacaggugaaucc

SEQ ID NO: 2731 - RNA, 21 nt, Oryza sativa
cgucaucucacaggugaaucc

SEQ ID NO: 2732 - RNA, 22 nt, Oryza sativa
augaaugugggaaauguaagaa

SEQ ID NO: 2733 - RNA, 22 nt, Oryza sativa
ugaaugugagaaauguuagaau

SEQ ID NO: 2734 - RNA, 22 nt, Oryza sativa
ugaaugugagaaauguuagaau

SEQ ID NO: 2735 - RNA, 22 nt, Oryza sativa
ugaaugugagaaauguuagaau

SEQ ID NO: 2736 - RNA, 22 nt, Oryza sativa
ugaaugugagaaauguuagaau

SEQ ID NO: 2737 - RNA, 22 nt, Oryza sativa
ugaaugugagaaauguuagaau

SEQ ID NO: 2738 - RNA, 22 nt, Oryza sativa
ugaaugugagaaauguuagaau

SEQ ID NO: 2739 - RNA, 22 nt, Oryza sativa
ugaaugugagaaauguuagaau

SEQ ID NO: 2740 - RNA, 22 nt, Oryza sativa
ugaaugugagaaauguuagaau

SEQ ID NO: 2741 - RNA, 21 nt, Oryza sativa
ucauaagcccaccacaugugg

SEQ ID NO: 2742 - RNA, 24 nt, Oryza sativa
accguuagaucgagaaauggacgu

SEQ ID NO: 2743 - RNA, 24 nt, Oryza sativa
accguuagaucgagaaauggacgu

SEQ ID NO: 2744 - RNA, 24 nt, Oryza sativa
accguuagaucgagaaauggacgu

SEQ ID NO: 2745 - RNA, 22 nt, Oryza sativa
gacggacgguuaaacguuggac

SEQ ID NO: 2746 - RNA, 22 nt, Oryza sativa
gacggacgguuaaacguuggac

SEQ ID NO: 2747 - RNA, 22 nt, Oryza sativa
gacggacgguuaaacguuggac

SEQ ID NO: 2748 - RNA, 22 nt, Oryza sativa
gacggacgguuaaacguuggac

SEQ ID NO: 2749 - RNA, 22 nt, Oryza sativa
gacggacgguuaaacguuggac

SEQ ID NO: 2750 - RNA, 22 nt, Oryza sativa
ggguuauggaauggguuuuacc

SEQ ID NO: 2751 - RNA, 22 nt, Oryza sativa
cacuucauaguacaacgaaucu

SEQ ID NO: 2752 - RNA, 22 nt, Oryza sativa
cacuucauaguacaacgaaucu

SEQ ID NO: 2753 - RNA, 22 nt, Oryza sativa
cacuucauaguacaacgaaucu

SEQ ID NO: 2754 - RNA, 21 nt, Oryza sativa
aaggggauugaggagauuggg

SEQ ID NO: 2755 - RNA, 21 nt, Oryza sativa
aaggggauugaggagauuggg

SEQ ID NO: 2756 - RNA, 21 nt, Oryza sativa
aaggggauugaggagauuggg

SEQ ID NO: 2757 - RNA, 20 nt, Oryza sativa
gugacauauuuuacuacaac

SEQ ID NO: 2758 - RNA, 21 nt, Oryza sativa
uccaacuugaggcccgauuga

SEQ ID NO: 2759 - RNA, 22 nt, Oryza sativa
aaucccuuauauuaugggacgg

SEQ ID NO: 2760 - RNA, 22 nt, Oryza sativa
aaucccuuauauuaugggacgg

SEQ ID NO: 2761 - RNA, 22 nt, Oryza sativa
aaucccuuauauuaugggacgg

SEQ ID NO: 2762 - RNA, 22 nt, Oryza sativa
aaucccuuauauuaugggacgg

SEQ ID NO: 2763 - RNA, 22 nt, Oryza sativa
aaucccuuauauuaugggacgg

SEQ ID NO: 2764 - RNA, 22 nt, Oryza sativa
ucagguuauaagacuuucuagc

SEQ ID NO: 2765 - RNA, 22 nt, Oryza sativa
ucagguuauaagacuuucuagc

SEQ ID NO: 2766 - RNA, 22 nt, Oryza sativa
ucagguuauaagacuuucuagc

SEQ ID NO: 2767 - RNA, 22 nt, Oryza sativa
ucagguuauaagacuuucuagc

SEQ ID NO: 2768 - RNA, 22 nt, Oryza sativa
ucagguuauaagacuuucuagc

SEQ ID NO: 2769 - RNA, 22 nt, Oryza sativa
ucagguuauaagacuuucuagc

SEQ ID NO: 2770 - RNA, 22 nt, Oryza sativa
ucagguuauaagacuuucuagc

SEQ ID NO: 2771 - RNA, 22 nt, Oryza sativa
ucagguuauaagacuuucuagc

SEQ ID NO: 2772 - RNA, 22 nt, Oryza sativa
ucagguuauaagacuuucuagc

SEQ ID NO: 2773 - RNA, 22 nt, Oryza sativa
ucagguuauaagacuuucuagc

SEQ ID NO: 2774 - RNA, 22 nt, Oryza sativa
ucagguuauaagacuuucuagc

SEQ ID NO: 2775 - RNA, 21 nt, Oryza sativa
cggccucguggauggaccagg

SEQ ID NO: 2776 - RNA, 21 nt, Oryza sativa
cggccucguggauggaccagg

SEQ ID NO: 2777 - RNA, 21 nt, Oryza sativa
cggccucguggauggaccagg

SEQ ID NO: 2778 - RNA, 24 nt, Oryza sativa
aagucaucaacaaaaaaguugaau

SEQ ID NO: 2779 - RNA, 24 nt, Oryza sativa
aagucaucaacaaaaaaguugaau

SEQ ID NO: 2780 - RNA, 24 nt, Oryza sativa
aagucaucaacaaaaaaguugaau

SEQ ID NO: 2781 - RNA, 21 nt, Pan paniscus
uggaauguaaagaaguaugua

SEQ ID NO: 2782 - RNA, 22 nt, Pan paniscus
aacccguagauccgaacuugug

SEQ ID NO: 2783 - RNA, 22 nt, Pan paniscus
uacaguacugugauaacugaag

SEQ ID NO: 2784 - RNA, 23 nt, Pan paniscus
agcagcauuguacagggcuauga

SEQ ID NO: 2785 - RNA, 20 nt, Pan paniscus
ucaaaugcucagacuccugu

SEQ ID NO: 2786 - RNA, 24 nt, Pan paniscus
aaaagugcuuacagugcagguagc

SEQ ID NO: 2787 - RNA, 21 nt, Pan paniscus
uaaagugcugacagugcagau

SEQ ID NO: 2788 - RNA, 23 nt, Pan paniscus
agcagcauuguacagggcuauca

SEQ ID NO: 2789 - RNA, 23 nt, Pan paniscus
uacccuguagauccgaauuugug

SEQ ID NO: 2790 - RNA, 22 nt, Pan paniscus
uacccuguagaaccgaauuugu

SEQ ID NO: 2791 - RNA, 22 nt, Pan paniscus
uuaaggcacgcggugaaugcca

SEQ ID NO: 2792 - RNA, 22 nt, Pan paniscus
ucccugagacccuaacuuguga

SEQ ID NO: 2793 - RNA, 22 nt, Pan paniscus
ucacagugaaccggucucuuuu

SEQ ID NO: 2794 - RNA, 20 nt, Pan paniscus
cagugcaauguuaaaagggc

SEQ ID NO: 2795 - RNA, 22 nt, Pan paniscus
uugguccccuucaaccagcugu

SEQ ID NO: 2796 - RNA, 21 nt, Pan paniscus
ugugacugguugaccagaggg

SEQ ID NO: 2797 - RNA, 23 nt, Pan paniscus
uauggcuuuuuauuccuauguga

SEQ ID NO: 2798 - RNA, 23 nt, Pan paniscus
acuccauuuguuuugaugaugga

SEQ ID NO: 2799 - RNA, 18 nt, Pan paniscus
ucuacagugcacgugucu

SEQ ID NO: 2800 - RNA, 21 nt, Pan paniscus
aacacugucugguaaagaugc

SEQ ID NO: 2801 - RNA, 22 nt, Pan paniscus
ugagaugaagcacuguagcuca

SEQ ID NO: 2802 - RNA, 22 nt, Pan paniscus
uacaguauagaugauguacuac

SEQ ID NO: 2803 - RNA, 20 nt, Pan paniscus
guguguggaaaugcuucugc

SEQ ID NO: 2804 - RNA, 22 nt, Pan paniscus
uagguuauccguguugccuucg

SEQ ID NO: 2805 - RNA, 22 nt, Pan paniscus
uagcagcacauaaugguuugug

SEQ ID NO: 2806 - RNA, 22 nt, Pan paniscus
uagcagcacaucaugguuuaca

SEQ ID NO: 2807 - RNA, 22 nt, Pan paniscus
uagcagcacguaaauauuggcg

SEQ ID NO: 2808 - RNA, 20 nt, Pan paniscus
acugcagugaaggcacuugu

SEQ ID NO: 2809 - RNA, 24 nt, Pan paniscus
caaagugcuuacagugcagguagu

SEQ ID NO: 2810 - RNA, 22 nt, Pan paniscus
uaaggugcaucuagugcagaua

SEQ ID NO: 2811 - RNA, 23 nt, Pan paniscus
aacauucaacgcugucggugagu

SEQ ID NO: 2812 - RNA, 22 nt, Pan paniscus
accaucgaccguugauuguacc

SEQ ID NO: 2813 - RNA, 24 nt, Pan paniscus
aacauucauugcugucgguggguu

SEQ ID NO: 2814 - RNA, 22 nt, Pan paniscus
aacauucaaccugucggugagu

SEQ ID NO: 2815 - RNA, 23 nt, Pan paniscus
uauggcacugguagaauucacug

SEQ ID NO: 2816 - RNA, 23 nt, Pan paniscus
caaagaauucuccuuuugggcuu

SEQ ID NO: 2817 - RNA, 21 nt, Pan paniscus
ucgugucuuguguugcagccg

SEQ ID NO: 2818 - RNA, 22 nt, Pan paniscus
caucccuugcaugguggagggu

SEQ ID NO: 2819 - RNA, 23 nt, Pan paniscus
gugccuacugagcugauaucagu

SEQ ID NO: 2820 - RNA, 22 nt, Pan paniscus
ugauauguuugauauauuaggu

SEQ ID NO: 2821 - RNA, 21 nt, Pan paniscus
uagcagcacagaaauauuggc

SEQ ID NO: 2822 - RNA, 22 nt, Pan paniscus
uagguaguuucauguuguuggg

SEQ ID NO: 2823 - RNA, 22 nt, Pan paniscus
uucaccaccuucuccacccagc

SEQ ID NO: 2824 - RNA, 19 nt, Pan paniscus
gguccagaggggagauagg

SEQ ID NO: 2825 - RNA, 23 nt, Pan paniscus
cccaguguucagacuaccuguuc

SEQ ID NO: 2826 - RNA, 23 nt, Pan paniscus
ugugcaaaucuaugcaaaacuga

SEQ ID NO: 2827 - RNA, 23 nt, Pan paniscus
ugugcaaauccaugcaaaacuga

SEQ ID NO: 2828 - RNA, 22 nt, Pan paniscus
uaaagugcuuauagugcaggua

SEQ ID NO: 2829 - RNA, 22 nt, Pan paniscus
uucccuuugucauccuaugccu

SEQ ID NO: 2830 - RNA, 22 nt, Pan paniscus
uccuucauuccaccggagucug

SEQ ID NO: 2831 - RNA, 22 nt, Pan paniscus
uagcuuaucagacugauguuga

SEQ ID NO: 2832 - RNA, 21 nt, Pan paniscus
acagcaggcacagacaggcag

SEQ ID NO: 2833 - RNA, 21 nt, Pan paniscus
uaaucucagcuggcaacugug

SEQ ID NO: 2834 - RNA, 24 nt, Pan paniscus
uacugcaucaggaacugauuggau

SEQ ID NO: 2835 - RNA, 21 nt, Pan paniscus
uugugcuugaucuaaccaugu

SEQ ID NO: 2836 - RNA, 22 nt, Pan paniscus
aagcugccaguugaagaacugu

SEQ ID NO: 2837 - RNA, 21 nt, Pan paniscus
ccacaccguaucugacacuuu

SEQ ID NO: 2838 - RNA, 23 nt, Pan paniscus
agcuacauugucugcuggguuuc

SEQ ID NO: 2839 - RNA, 21 nt, Pan paniscus
ugucaguuugucaaauacccc

SEQ ID NO: 2840 - RNA, 23 nt, Pan paniscus
caagucacuagugguuccguuua

SEQ ID NO: 2841 - RNA, 21 nt, Pan paniscus
aucacauugccagggauuucc

SEQ ID NO: 2842 - RNA, 23 nt, Pan paniscus
aucacauugccagggauuaccac

SEQ ID NO: 2843 - RNA, 22 nt, Pan paniscus
uggcucaguucagcaggaacag

SEQ ID NO: 2844 - RNA, 22 nt, Pan paniscus
cauugcacuugucucggucuga

SEQ ID NO: 2845 - RNA, 22 nt, Pan paniscus
uucaaguaauccaggauaggcu

SEQ ID NO: 2846 - RNA, 22 nt, Pan paniscus
uucacaguggcuaaguuccgcc

SEQ ID NO: 2847 - RNA, 22 nt, Pan paniscus
aaggagcucacagucuauugag

SEQ ID NO: 2848 - RNA, 22 nt, Pan paniscus
cuagcaccaucugaaaucgguu

SEQ ID NO: 2849 - RNA, 20 nt, Pan paniscus
uagcaccauuugaaaucagu

SEQ ID NO: 2850 - RNA, 22 nt, Pan paniscus
cuuucagucggauguuugcagc

SEQ ID NO: 2851 - RNA, 22 nt, Pan paniscus
uguaaacauccucgacuggaag

SEQ ID NO: 2852 - RNA, 21 nt, Pan paniscus
uguaaacauccuacacucagc

SEQ ID NO: 2853 - RNA, 22 nt, Pan paniscus
uguaaacauccccgacuggaag

SEQ ID NO: 2854 - RNA, 21 nt, Pan paniscus
ggcaagaugcuggcauagcug

SEQ ID NO: 2855 - RNA, 21 nt, Pan paniscus
uauugcacauuacuaaguugc

SEQ ID NO: 2856 - RNA, 19 nt, Pan paniscus
gugcauuguaguugcauug

SEQ ID NO: 2857 - RNA, 22 nt, Pan paniscus
uggcagugucuuagcugguugu

SEQ ID NO: 2858 - RNA, 21 nt, Pan paniscus
uggaagacuagugauuuuguu

SEQ ID NO: 2859 - RNA, 22 nt, Pan paniscus
uauugcacuugucccggccugu

SEQ ID NO: 2860 - RNA, 22 nt, Pan paniscus
aaagugcuguucgugcagguag

SEQ ID NO: 2861 - RNA, 22 nt, Pan paniscus
uucaacggguauuuauugagca

SEQ ID NO: 2862 - RNA, 22 nt, Pan paniscus
uuuggcacuagcacauuuuugc

SEQ ID NO: 2863 - RNA, 22 nt, Pan paniscus
ugagguaguaaguuguauuguu

SEQ ID NO: 2864 - RNA, 22 nt, Pan paniscus
aacccguagauccgaucuugug

SEQ ID NO: 2865 - RNA, 21 nt, Physcomitrella patens
agaagccuuugugggagagga

SEQ ID NO: 2866 - RNA, 21 nt, Physcomitrella patens
agggagggaugguuaugcaag

SEQ ID NO: 2867 - RNA, 21 nt, Physcomitrella patens
cgugggacagcauagaaugcg

SEQ ID NO: 2868 - RNA, 21 nt, Physcomitrella patens
guuggaagccuucgugggaga

SEQ ID NO: 2869 - RNA, 21 nt, Physcomitrella patens
uacuaugagaaucucgcggcc

SEQ ID NO: 2870 - RNA, 21 nt, Physcomitrella patens
ucauugcaaaacuguauacga

SEQ ID NO: 2871 - RNA, 21 nt, Physcomitrella patens
ugauggugaugcgcuuguauc

SEQ ID NO: 2872 - RNA, 21 nt, Physcomitrella patens
aauuugaagcaugaugucaag

SEQ ID NO: 2873 - RNA, 21 nt, Physcomitrella patens
ccuuagagucguaggccucug

SEQ ID NO: 2874 - RNA, 21 nt, Physcomitrella patens
cuuccugccucucacuagcuu

SEQ ID NO: 2875 - RNA, 21 nt, Physcomitrella patens
cuuccugccucucacuagcuu

SEQ ID NO: 2876 - RNA, 21 nt, Physcomitrella patens
cuuccugccucucacuagcuu

SEQ ID NO: 2877 - RNA, 20 nt, Physcomitrella patens
uuccugccucucacuagcuu

SEQ ID NO: 2878 - RNA, 21 nt, Physcomitrella patens
gaagauagaggaguucaagaa

SEQ ID NO: 2879 - RNA, 21 nt, Physcomitrella patens
gaagauagaggaguucaagaa

SEQ ID NO: 2880 - RNA, 21 nt, Physcomitrella patens
uggauggugugcagggucaaa

SEQ ID NO: 2881 - RNA, 21 nt, Physcomitrella patens
uugaaggaguucauugguaua

SEQ ID NO: 2882 - RNA, 21 nt, Physcomitrella patens
uuguagagucauacaccucca

SEQ ID NO: 2883 - RNA, 20 nt, Physcomitrella patens
ugacagaagagagugagcac

SEQ ID NO: 2884 - RNA, 20 nt, Physcomitrella patens
cuuggacugaagggagcucc

SEQ ID NO: 2885 - RNA, 20 nt, Physcomitrella patens
cuuggacugaagggagcucc

SEQ ID NO: 2886 - RNA, 21 nt, Physcomitrella patens
cuuggacugaagggagcuccc

SEQ ID NO: 2887 - RNA, 21 nt, Physcomitrella patens
cuuggacugaagggagcuccc

SEQ ID NO: 2888 - RNA, 21 nt, Physcomitrella patens
aagcucaggagggauagcgcc

SEQ ID NO: 2889 - RNA, 21 nt, Physcomitrella patens
aagcucaggagggauagcgcc

SEQ ID NO: 2890 - RNA, 20 nt, Physcomitrella patens
agcucaggagggauagcgcc

SEQ ID NO: 2891 - RNA, 21 nt, Physcomitrella patens
gagcuggccaggcugugaggg

SEQ ID NO: 2892 - RNA, 21 nt, Physcomitrella patens
gagcuguccaggcugugaggg

SEQ ID NO: 2893 - RNA, 22 nt, Physcomitrella patens
uauguccauugcaguugcauac

SEQ ID NO: 2894 - RNA, 21 nt, Physcomitrella patens
ugacaacgagagagagcacgc

SEQ ID NO: 2895 - RNA, 21 nt, Physcomitrella patens
ugacaacgagagagagcacgc

SEQ ID NO: 2896 - RNA, 21 nt, Physcomitrella patens
ugacaacgagagagagcacgc

SEQ ID NO: 2897 - RNA, 22 nt, Physcomitrella patens
ugacaacgagagagagcacgcc

SEQ ID NO: 2898 - RNA, 22 nt, Physcomitrella patens
uucgugccaagcugugugcaac

SEQ ID NO: 2899 - RNA, 21 nt, Physcomitrella patens
uugagguguuucuacaggcua

SEQ ID NO: 2900 - RNA, 21 nt, Physcomitrella patens
uugagguguuucuacaggcua

SEQ ID NO: 2901 - RNA, 22 nt, Physcomitrella patens
uugcauggagucuaugucugga

SEQ ID NO: 2902 - RNA, 22 nt, Physcomitrella patens
uugcauggagucuaugucugga

SEQ ID NO: 2903 - RNA, 22 nt, Physcomitrella patens
uugcauggagucuaugucugga

SEQ ID NO: 2904 - RNA, 22 nt, Pongo pygmaeus
aacccguagauccgaacuugug

SEQ ID NO: 2905 - RNA, 22 nt, Pongo pygmaeus
uacaguacugugauaacugaag

SEQ ID NO: 2906 - RNA, 23 nt, Pongo pygmaeus
agcagcauuguacagggcuauga

SEQ ID NO: 2907 - RNA, 20 nt, Pongo pygmaeus
ucaaaugcucagacuccugu

SEQ ID NO: 2908 - RNA, 24 nt, Pongo pygmaeus
aaaagugcuuacagugcagguagc

SEQ ID NO: 2909 - RNA, 21 nt, Pongo pygmaeus
uaaagugcugacagugcagau

SEQ ID NO: 2910 - RNA, 23 nt, Pongo pygmaeus
agcagcauuguacagggcuauca

SEQ ID NO: 2911 - RNA, 23 nt, Pongo pygmaeus
uaccccguagauccgaauuugug

SEQ ID NO: 2912 - RNA, 22 nt, Pongo pygmaeus
uuaaggcacgcggugaaugcca

SEQ ID NO: 2913 - RNA, 22 nt, Pongo pygmaeus
ucccugagacccuaacuuguga

SEQ ID NO: 2914 - RNA, 22 nt, Pongo pygmaeus
ucggauccgucugagcuuggcu

SEQ ID NO: 2915 - RNA, 22 nt, Pongo pygmaeus
ucacagugaaccggucucuuuu

SEQ ID NO: 2916 - RNA, 21 nt, Pongo pygmaeus
uuguccccuucaaccagcugu

SEQ ID NO: 2917 - RNA, 21 nt, Pongo pygmaeus
ugugacugguugaccagaggg

SEQ ID NO: 2918 - RNA, 23 nt, Pongo pygmaeus
uauggcuuuuuauuccuauguga

SEQ ID NO: 2919 - RNA, 23 nt, Pongo pygmaeus
acuccauuuguuuugaugaugga

SEQ ID NO: 2920 - RNA, 21 nt, Pongo pygmaeus
aacacugucugguaaagaugg

SEQ ID NO: 2921 - RNA, 22 nt, Pongo pygmaeus
ugagaugaagcacuguagcuca

SEQ ID NO: 2922 - RNA, 22 nt, Pongo pygmaeus
uacaguauagaugauguacuag

SEQ ID NO: 2923 - RNA, 24 nt, Pongo pygmaeus
guccaguuuucccaggaaucccuu

SEQ ID NO: 2924 - RNA, 20 nt, Pongo pygmaeus
guguguggaaaugcuucugc

SEQ ID NO: 2925 - RNA, 20 nt, Pongo pygmaeus
uugcauagucacaaaaguga

SEQ ID NO: 2926 - RNA, 22 nt, Pongo pygmaeus
uagguuauccguguugccuucg

SEQ ID NO: 2927 - RNA, 22 nt, Pongo pygmaeus
uagcagcacauaaugguuugug

SEQ ID NO: 2928 - RNA, 22 nt, Pongo pygmaeus
uagcagcacaucaugguuuaca

SEQ ID NO: 2929 - RNA, 22 nt, Pongo pygmaeus
uagcagcacguaaauauuggcg

SEQ ID NO: 2930 - RNA, 20 nt, Pongo pygmaeus
acugcagugaaggcacuugu

SEQ ID NO: 2931 - RNA, 24 nt, Pongo pygmaeus
caaagugcuuacagugcagguagu

SEQ ID NO: 2932 - RNA, 22 nt, Pongo pygmaeus
uaaggugcaucuagugcagaua

SEQ ID NO: 2933 - RNA, 23 nt, Pongo pygmaeus
aacauucaacgcugucggugagu

SEQ ID NO: 2934 - RNA, 22 nt, Pongo pygmaeus
accaucgaccguugauuguacc

SEQ ID NO: 2935 - RNA, 24 nt, Pongo pygmaeus
aacauucauugcugucgguggguu

SEQ ID NO: 2936 - RNA, 22 nt, Pongo pygmaeus
uuuggcaaugguagaacucaca

SEQ ID NO: 2937 - RNA, 22 nt, Pongo pygmaeus
uggacggagaacugauaagggu

SEQ ID NO: 2938 - RNA, 21 nt, Pongo pygmaeus
ucgugucuuguguugcagccg

SEQ ID NO: 2939 - RNA, 22 nt, Pongo pygmaeus
caucccuugcaugguggagggu

SEQ ID NO: 2940 - RNA, 23 nt, Pongo pygmaeus
gugccuacugagcugauaucagu

SEQ ID NO: 2941 - RNA, 22 nt, Pongo pygmaeus
uguaacagcaacuccaugugga

SEQ ID NO: 2942 - RNA, 21 nt, Pongo pygmaeus
uagguaguuucauguuguugg

SEQ ID NO: 2943 - RNA, 22 nt, Pongo pygmaeus
uagguaguuucauguuguuggg

SEQ ID NO: 2944 - RNA, 22 nt, Pongo pygmaeus
uucaccaccuucuccacccagc

SEQ ID NO: 2945 - RNA, 19 nt, Pongo pygmaeus
gguccagaggggagauagg

SEQ ID NO: 2946 - RNA, 23 nt, Pongo pygmaeus
cccaguguucagacuaccuguuc

SEQ ID NO: 2947 - RNA, 23 nt, Pongo pygmaeus
ugugcaaaucuaugcaaaacuga

SEQ ID NO: 2948 - RNA, 23 nt, Pongo pygmaeus
ugugcaaauccaugcaaaacuga

SEQ ID NO: 2949 - RNA, 22 nt, Pongo pygmaeus
uaaagugcuuauagugcaggua

SEQ ID NO: 2950 - RNA, 22 nt, Pongo pygmaeus
aauacugccggguaaugaugga

SEQ ID NO: 2951 - RNA, 22 nt, Pongo pygmaeus
uucccuuugucauccuaugccu

SEQ ID NO: 2952 - RNA, 22 nt, Pongo pygmaeus
uggaauguaaggaagugugugg

SEQ ID NO: 2953 - RNA, 22 nt, Pongo pygmaeus
uagcuuaucagacugauguuga

SEQ ID NO: 2954 - RNA, 22 nt, Pongo pygmaeus
uucccuuugucauccuucgccu

SEQ ID NO: 2955 - RNA, 21 nt, Pongo pygmaeus
acagcaggcacagacaggcag

SEQ ID NO: 2956 - RNA, 21 nt, Pongo pygmaeus
augaccuaugaauugacagac

SEQ ID NO: 2957 - RNA, 21 nt, Pongo pygmaeus
uaaucucagcuggcaacugug

SEQ ID NO: 2958 - RNA, 21 nt, Pongo pygmaeus
uugugcuugaucuaaccaugu

SEQ ID NO: 2959 - RNA, 21 nt, Pongo pygmaeus
ugauuguccaaacgcaauucu

SEQ ID NO: 2960 - RNA, 22 nt, Pongo pygmaeus
aagcugccaguugaagaacugu

SEQ ID NO: 2961 - RNA, 23 nt, Pongo pygmaeus
agcuacauugucugcuggguuuc

SEQ ID NO: 2962 - RNA, 21 nt, Pongo pygmaeus
ugucaguuugucaaauacccc

SEQ ID NO: 2963 - RNA, 23 nt, Pongo pygmaeus
caagucacuagugguuccguuua

SEQ ID NO: 2964 - RNA, 21 nt, Pongo pygmaeus
aucacauugccagggauuucc

SEQ ID NO: 2965 - RNA, 23 nt, Pongo pygmaeus
aucacauugccagggauuaccac

SEQ ID NO: 2966 - RNA, 22 nt, Pongo pygmaeus
uggcucaguucagcaggaacag

SEQ ID NO: 2967 - RNA, 22 nt, Pongo pygmaeus
cauugcacuugucucggucuga

SEQ ID NO: 2968 - RNA, 22 nt, Pongo pygmaeus
uucaaguaauccaggauaggcu

SEQ ID NO: 2969 - RNA, 22 nt, Pongo pygmaeus
uucacaguggcuaaguuccgcc

SEQ ID NO: 2970 - RNA, 22 nt, Pongo pygmaeus
aaggagcucacagucuauugag

SEQ ID NO: 2971 - RNA, 22 nt, Pongo pygmaeus
cuagcaccaucugaaaucgguu

SEQ ID NO: 2972 - RNA, 20 nt, Pongo pygmaeus
uagcaccauuugaaaucagu

SEQ ID NO: 2973 - RNA, 22 nt, Pongo pygmaeus
cuuucagucggauguuugcagc

SEQ ID NO: 2974 - RNA, 22 nt, Pongo pygmaeus
uguaaacauccucgacuggaag

SEQ ID NO: 2975 - RNA, 21 nt, Pongo pygmaeus
ggcaagaugcuggcauagcug

SEQ ID NO: 2976 - RNA, 21 nt, Pongo pygmaeus
uauugcacauuacuaaguugc

SEQ ID NO: 2977 - RNA, 19 nt, Pongo pygmaeus
gugcauuguaguugcauug

SEQ ID NO: 2978 - RNA, 22 nt, Pongo pygmaeus
uggcagugucuuagcugguugu

SEQ ID NO: 2979 - RNA, 21 nt, Pongo pygmaeus
uggaagacuagugauuuuguu

SEQ ID NO: 2980 - RNA, 22 nt, Pongo pygmaeus
uauugcacuugucccggccugu

SEQ ID NO: 2981 - RNA, 22 nt, Pongo pygmaeus
aaagugcuguucgugcagguag

SEQ ID NO: 2982 - RNA, 22 nt, Pongo pygmaeus
uucaacggguauuuauugagca

SEQ ID NO: 2983 - RNA, 22 nt, Pongo pygmaeus
ugagguaguaaguuguauuguu

SEQ ID NO: 2984 - RNA, 22 nt, Pongo pygmaeus
aacccguagauccgaucuugug

SEQ ID NO: 2985 - RNA, 20 nt, Populus trichocarpa
ugacagaagagagugagcac

SEQ ID NO: 2986 - RNA, 20 nt, Populus trichocarpa
ugacagaagagagugagcac

SEQ ID NO: 2987 - RNA, 20 nt, Populus trichocarpa
ugacagaagagagugagcac

SEQ ID NO: 2988 - RNA, 20 nt, Populus trichocarpa
ugacagaagagagugagcac

SEQ ID NO: 2989 - RNA, 20 nt, Populus trichocarpa
ugacagaagagagugagcac

SEQ ID NO: 2990 - RNA, 20 nt, Populus trichocarpa
ugacagaagagagugagcac

SEQ ID NO: 2991 - RNA, 21 nt, Populus trichocarpa
uugacagaagauagagagcac

SEQ ID NO: 2992 - RNA, 21 nt, Populus trichocarpa
uugacagaagauagagagcac

SEQ ID NO: 2993 - RNA, 21 nt, Populus trichocarpa
uugacagaagauagagagcac

SEQ ID NO: 2994 - RNA, 21 nt, Populus trichocarpa
uugacagaagauagagagcac

SEQ ID NO: 2995 - RNA, 20 nt, Populus trichocarpa
ugacagaagagagggagcac

SEQ ID NO: 2996 - RNA, 21 nt, Populus trichocarpa
uuuggauugaagggagcucua

SEQ ID NO: 2997 - RNA, 21 nt, Populus trichocarpa
uuuggauugaagggagcucua

SEQ ID NO: 2998 - RNA, 21 nt, Populus trichocarpa
uuuggauugaagggagcucua

SEQ ID NO: 2999 - RNA, 21 nt, Populus trichocarpa
cuuggauugaagggagcuccu

SEQ ID NO: 3000 - RNA, 21 nt, Populus trichocarpa
cuuggggugaagggagcuccu

SEQ ID NO: 3001 - RNA, 21 nt, Populus trichocarpa
auuggagugaagggagcucga

SEQ ID NO: 3002 - RNA, 21 nt, Populus trichocarpa
ugccuggcucccuguaugcca

SEQ ID NO: 3003 - RNA, 21 nt, Populus trichocarpa
ugccuggcucccuguaugcca

SEQ ID NO: 3004 - RNA, 21 nt, Populus trichocarpa
ugccuggcucccuguaugcca

SEQ ID NO: 3005 - RNA, 21 nt, Populus trichocarpa
ugccuggcucccuguaugcca

SEQ ID NO: 3006 - RNA, 21 nt, Populus trichocarpa
ugccuggcucccugaaugcca

SEQ ID NO: 3007 - RNA, 21 nt, Populus trichocarpa
ugccuggcucccugaaugcca

SEQ ID NO: 3008 - RNA, 21 nt, Populus trichocarpa
ugccuggcucccuggaugcca

SEQ ID NO: 3009 - RNA, 21 nt, Populus trichocarpa
ugccuggcucccugcaugcca

SEQ ID NO: 3010 - RNA, 21 nt, Populus trichocarpa
ucgauaaaccucugcauccag

SEQ ID NO: 3011 - RNA, 21 nt, Populus trichocarpa
ucgauaaaccucugcauccag

SEQ ID NO: 3012 - RNA, 21 nt, Populus trichocarpa
ucgauaaaccucugcauccag

SEQ ID NO: 3013 - RNA, 21 nt, Populus trichocarpa
uggagaagcagggcacgugca

SEQ ID NO: 3014 - RNA, 21 nt, Populus trichocarpa
uggagaagcagggcacgugca

SEQ ID NO: 3015 - RNA, 21 nt, Populus trichocarpa
uggagaagcagggcacgugca

SEQ ID NO: 3016 - RNA, 21 nt, Populus trichocarpa
uggagaagcagggcacgugca

SEQ ID NO: 3017 - RNA, 21 nt, Populus trichocarpa
uggagaagcagggcacgugca

SEQ ID NO: 3018 - RNA, 21 nt, Populus trichocarpa
uggagaagcagggcacaugcu

SEQ ID NO: 3019 - RNA, 21 nt, Populus trichocarpa
ucggaccaggcuucauucccc

SEQ ID NO: 3020 - RNA, 21 nt, Populus trichocarpa
ucggaccaggcuucauucccc

SEQ ID NO: 3021 - RNA, 21 nt, Populus trichocarpa
ucggaccaggcuucauucccc

SEQ ID NO: 3022 - RNA, 21 nt, Populus trichocarpa
ucggaccaggcuucauucccc

SEQ ID NO: 3023 - RNA, 21 nt, Populus trichocarpa
ucggaccaggcuucauucccc

SEQ ID NO: 3024 - RNA, 21 nt, Populus trichocarpa
ucggaccaggcuucauucccc

SEQ ID NO: 3025 - RNA, 21 nt, Populus trichocarpa
ucggaccaggcuucauucccc

SEQ ID NO: 3026 - RNA, 21 nt, Populus trichocarpa
ucggaccaggcuucauucccc

SEQ ID NO: 3027 - RNA, 21 nt, Populus trichocarpa
ucggaccaggcuucauucccc

SEQ ID NO: 3028 - RNA, 21 nt, Populus trichocarpa
ucggaccaggcuucauucccc

SEQ ID NO: 3029 - RNA, 21 nt, Populus trichocarpa
ucggaccaggcuucauucccc

SEQ ID NO: 3030 - RNA, 21 nt, Populus trichocarpa
ucggaccaggcuucauucccc

SEQ ID NO: 3031 - RNA, 21 nt, Populus trichocarpa
ucggaccaggcuucauucccc

SEQ ID NO: 3032 - RNA, 21 nt, Populus trichocarpa
ucggaccaggcuucauuccuu

SEQ ID NO: 3033 - RNA, 21 nt, Populus trichocarpa
ucggaccaggcuucauuccuu

SEQ ID NO: 3034 - RNA, 21 nt, Populus trichocarpa
ucggaccaggcuccauuccuu

SEQ ID NO: 3035 - RNA, 21 nt, Populus trichocarpa
ucggaccaggcuucauuccuu

SEQ ID NO: 3036 - RNA, 21 nt, Populus trichocarpa
ugaagcugccagcaugaucua

SEQ ID NO: 3037 - RNA, 21 nt, Populus trichocarpa
ugaagcugccagcaugaucua

SEQ ID NO: 3038 - RNA, 21 nt, Populus trichocarpa
ugaagcugccagcaugaucua

SEQ ID NO: 3039 - RNA, 21 nt, Populus trichocarpa
ugaagcugccagcaugaucua

SEQ ID NO: 3040 - RNA, 21 nt, Populus trichocarpa
ugaagcugccagcaugaucug

SEQ ID NO: 3041 - RNA, 21 nt, Populus trichocarpa
ugaagcugccagcaugaucuu

SEQ ID NO: 3042 - RNA, 21 nt, Populus trichocarpa
ugaagcugccagcaugaucuu

SEQ ID NO: 3043 - RNA, 21 nt, Populus trichocarpa
ugaagcugccaacaugaucug

SEQ ID NO: 3044 - RNA, 21 nt, Populus trichocarpa
ucgcuuggugcaggucgggaa

SEQ ID NO: 3045 - RNA, 21 nt, Populus trichocarpa
ucgcuuggugcaggucgggaa

SEQ ID NO: 3046 - RNA, 21 nt, Populus trichocarpa
cagccaaggaugacuugccga

SEQ ID NO: 3047 - RNA, 21 nt, Populus trichocarpa
gagccaagaaugacuugucgg

SEQ ID NO: 3048 - RNA, 21 nt, Populus trichocarpa
uagccaaggacgacuugccca

SEQ ID NO: 3049 - RNA, 21 nt, Populus trichocarpa
uagccaaggacgacuugccca

SEQ ID NO: 3050 - RNA, 21 nt, Populus trichocarpa
uagccaaggacgacuugccca

SEQ ID NO: 3051 - RNA, 21 nt, Populus trichocarpa
uagccaaggacgacuugccca

SEQ ID NO: 3052 - RNA, 21 nt, Populus trichocarpa
uagccaaggacgacuugccca

SEQ ID NO: 3053 - RNA, 21 nt, Populus trichocarpa
cagccaaggaugacuugccga

SEQ ID NO: 3054 - RNA, 21 nt, Populus trichocarpa
cagccaaggaugacuugccga

SEQ ID NO: 3055 - RNA, 21 nt, Populus trichocarpa
cagccaaggaugacuugccgg

SEQ ID NO: 3056 - RNA, 21 nt, Populus trichocarpa
cagccaaggaugacuugccgg

SEQ ID NO: 3057 - RNA, 21 nt, Populus trichocarpa
cagccaaggaugacuugccgg

SEQ ID NO: 3058 - RNA, 21 nt, Populus trichocarpa
cagccaaggaugacuugccgg

SEQ ID NO: 3059 - RNA, 21 nt, Populus trichocarpa
cagccaaggaugacuugccgg

SEQ ID NO: 3060 - RNA, 21 nt, Populus trichocarpa
uagccaaggaugacuugccug

SEQ ID NO: 3061 - RNA, 21 nt, Populus trichocarpa
uagccaaggaugacuugccug

SEQ ID NO: 3062 - RNA, 21 nt, Populus trichocarpa
uagccaaggaugacuugccug

SEQ ID NO: 3063 - RNA, 21 nt, Populus trichocarpa
uagccaaggaugacuugccug

SEQ ID NO: 3064 - RNA, 21 nt, Populus trichocarpa
uagccaaggaugacuugccug

SEQ ID NO: 3065 - RNA, 21 nt, Populus trichocarpa
ugagccaaggaugacuugccg

SEQ ID NO: 3066 - RNA, 21 nt, Populus trichocarpa
aagccaaggaugacuugccug

SEQ ID NO: 3067 - RNA, 21 nt, Populus trichocarpa
aagccaaggaugacuugccug

SEQ ID NO: 3068 - RNA, 21 nt, Populus trichocarpa
uagccaaggacgacuugccug

SEQ ID NO: 3069 - RNA, 21 nt, Populus trichocarpa
uagccaaggaugacuugccua

SEQ ID NO: 3070 - RNA, 21 nt, Populus trichocarpa
ucagccaaggaugacuugccg

SEQ ID NO: 3071 - RNA, 21 nt, Populus trichocarpa
gagccaagaaugacuugccgg

SEQ ID NO: 3072 - RNA, 21 nt, Populus trichocarpa
uagccaaggacgacuugccua

SEQ ID NO: 3073 - RNA, 21 nt, Populus trichocarpa
uagccaaggaugacuugccca

SEQ ID NO: 3074 - RNA, 21 nt, Populus trichocarpa
uagccaaggaugacuugccca

SEQ ID NO: 3075 - RNA, 21 nt, Populus trichocarpa
uagccaaggaugacuugcucg

SEQ ID NO: 3076 - RNA, 21 nt, Populus trichocarpa
uagccauggaugaauugccug

SEQ ID NO: 3077 - RNA, 21 nt, Populus trichocarpa
cagccaagaaugauuugccgg

SEQ ID NO: 3078 - RNA, 21 nt, Populus trichocarpa
uugagccgugccaauaucacg

SEQ ID NO: 3079 - RNA, 21 nt, Populus trichocarpa
uugagccgugccaauaucacg

SEQ ID NO: 3080 - RNA, 21 nt, Populus trichocarpa
agauugagccgcgccaauauc

SEQ ID NO: 3081 - RNA, 21 nt, Populus trichocarpa
agauugagccgcgccaauauc

SEQ ID NO: 3082 - RNA, 21 nt, Populus trichocarpa
ugauugagccgugccaauauc

SEQ ID NO: 3083 - RNA, 21 nt, Populus trichocarpa
ugauugagccgugccaauauc

SEQ ID NO: 3084 - RNA, 21 nt, Populus trichocarpa
ugauugagccgugccaauauc

SEQ ID NO: 3085 - RNA, 21 nt, Populus trichocarpa
ugauugagccgugccaauauc

SEQ ID NO: 3086 - RNA, 21 nt, Populus trichocarpa
ugauugagccgugccaauauc

SEQ ID NO: 3087 - RNA, 21 nt, Populus trichocarpa
ggauugagccgcgccaauacu

SEQ ID NO: 3088 - RNA, 21 nt, Populus trichocarpa
ggauugagccgcgccaauauc

SEQ ID NO: 3089 - RNA, 21 nt, Populus trichocarpa
agaaucuugaugaugcugcau

SEQ ID NO: 3090 - RNA, 21 nt, Populus trichocarpa
agaaucuugaugaugcugcau

SEQ ID NO: 3091 - RNA, 21 nt, Populus trichocarpa
agaaucuugaugaugcugcau

SEQ ID NO: 3092 - RNA, 21 nt, Populus trichocarpa
ggaaucuugaugaugcugcau

SEQ ID NO: 3093 - RNA, 21 nt, Populus trichocarpa
ggaaucuugaugaugcugcau

SEQ ID NO: 3094 - RNA, 21 nt, Populus trichocarpa
agaaucuugaugaugcugcau

SEQ ID NO: 3095 - RNA, 21 nt, Populus trichocarpa
ggaaucuugaugaugcugcag

SEQ ID NO: 3096 - RNA, 21 nt, Populus trichocarpa
ggaaucuugaugaugcugcag

SEQ ID NO: 3097 - RNA, 21 nt, Populus trichocarpa
agaauccugaugaugcugcaa

SEQ ID NO: 3098 - RNA, 20 nt, Populus trichocarpa
uuggacugaagggagcuccc

SEQ ID NO: 3099 - RNA, 20 nt, Populus trichocarpa
uuggacugaagggagcuccc

SEQ ID NO: 3100 - RNA, 20 nt, Populus trichocarpa
uuggacugaagggagcuccc

SEQ ID NO: 3101 - RNA, 20 nt, Populus trichocarpa
uuggacugaagggagcuccc

SEQ ID NO: 3102 - RNA, 20 nt, Populus trichocarpa
uuggacugaagggagcuccu

SEQ ID NO: 3103 - RNA, 20 nt, Populus trichocarpa
uuggacugaagggagcuccu

SEQ ID NO: 3104 - RNA, 20 nt, Populus trichocarpa
uuggacugaagggagcuccu

SEQ ID NO: 3105 - RNA, 20 nt, Populus trichocarpa
uuggacugaagggagcuccu

SEQ ID NO: 3106 - RNA, 20 nt, Populus trichocarpa
uugggcugaagggagcuccc

SEQ ID NO: 3107 - RNA, 21 nt, Populus trichocarpa
aagcucaggagggauagcgcc

SEQ ID NO: 3108 - RNA, 21 nt, Populus trichocarpa
aagcucaggagggauagcgcc

SEQ ID NO: 3109 - RNA, 21 nt, Populus trichocarpa
aagcucaggagggauagcgcc

SEQ ID NO: 3110 - RNA, 21 nt, Populus trichocarpa
aagcucaggagggauagcgcc

SEQ ID NO: 3111 - RNA, 21 nt, Populus trichocarpa
uccaaagggaucgcauugauc

SEQ ID NO: 3112 - RNA, 21 nt, Populus trichocarpa
uccaaagggaucgcauugauc

SEQ ID NO: 3113 - RNA, 21 nt, Populus trichocarpa
uccaaagggaucgcauugauc

SEQ ID NO: 3114 - RNA, 21 nt, Populus trichocarpa
uccaaagggaucgcauugauc

SEQ ID NO: 3115 - RNA, 20 nt, Populus trichocarpa
uuggcauucuguccaccucc

SEQ ID NO: 3116 - RNA, 20 nt, Populus trichocarpa
uuggcauucuguccaccucc

SEQ ID NO: 3117 - RNA, 21 nt, Populus trichocarpa
cugaaggguuuggaggaacuc

SEQ ID NO: 3118 - RNA, 21 nt, Populus trichocarpa
cugaaguguuugggggaacuc

SEQ ID NO: 3119 - RNA, 21 nt, Populus trichocarpa
cugaaguguuugggggaacuc

SEQ ID NO: 3120 - RNA, 21 nt, Populus trichocarpa
cugaaguguuugggggaacuc

SEQ ID NO: 3121 - RNA, 21 nt, Populus trichocarpa
cugaaguguuugggggaacuc

SEQ ID NO: 3122 - RNA, 21 nt, Populus trichocarpa
cugaaguguuugggggaacuc

SEQ ID NO: 3123 - RNA, 21 nt, Populus trichocarpa
cugaaguguuugggggaacuc

SEQ ID NO: 3124 - RNA, 21 nt, Populus trichocarpa
cugaaguguuugggggaacuc

SEQ ID NO: 3125 - RNA, 21 nt, Populus trichocarpa
cugaaguguuugggggaacuc

SEQ ID NO: 3126 - RNA, 21 nt, Populus trichocarpa
cugaaguguuugggggaacuc

SEQ ID NO: 3127 - RNA, 21 nt, Populus trichocarpa
uuccacagcuuucuugaacug

SEQ ID NO: 3128 - RNA, 21 nt, Populus trichocarpa
uuccacagcuuucuugaacug

SEQ ID NO: 3129 - RNA, 21 nt, Populus trichocarpa
uuccacagcuuucuugaacuu

SEQ ID NO: 3130 - RNA, 21 nt, Populus trichocarpa
uuccacagcuuucuugaacuu

SEQ ID NO: 3131 - RNA, 21 nt, Populus trichocarpa
uuccacagcuuucuugaacuu

SEQ ID NO: 3132 - RNA, 21 nt, Populus trichocarpa
uuccacggcuuucuugaacug

SEQ ID NO: 3133 - RNA, 21 nt, Populus trichocarpa
uuccacggcuuucuugaacuu

SEQ ID NO: 3134 - RNA, 21 nt, Populus trichocarpa
ucauugagugcagcguugaug

SEQ ID NO: 3135 - RNA, 21 nt, Populus trichocarpa
ccauugagugcagcguugaug

SEQ ID NO: 3136 - RNA, 21 nt, Populus trichocarpa
ucauugaguggagcuuugaug

SEQ ID NO: 3137 - RNA, 21 nt, Populus trichocarpa
uguguucucaggucaccccuu

SEQ ID NO: 3138 - RNA, 21 nt, Populus trichocarpa
uguguucucaggucgccccug

SEQ ID NO: 3139 - RNA, 21 nt, Populus trichocarpa
uguguucucaggucgccccug

SEQ ID NO: 3140 - RNA, 21 nt, Populus trichocarpa
ugccaaaggagauuugccccg

SEQ ID NO: 3141 - RNA, 21 nt, Populus trichocarpa
ugccaaaggagauuugcccgg

SEQ ID NO: 3142 - RNA, 21 nt, Populus trichocarpa
ugccaaaggagauuugcccgg

SEQ ID NO: 3143 - RNA, 21 nt, Populus trichocarpa
ugccaaagaagauuugccccg

SEQ ID NO: 3144 - RNA, 21 nt, Populus trichocarpa
ugccaaagaagauuugccccg

SEQ ID NO: 3145 - RNA, 21 nt, Populus trichocarpa
ugccaaaggagaauugcccug

SEQ ID NO: 3146 - RNA, 21 nt, Populus trichocarpa
ugccaaaggagaauugcccug

SEQ ID NO: 3147 - RNA, 21 nt, Populus trichocarpa
ugccaaaggagaguuucccug

SEQ ID NO: 3148 - RNA, 21 nt, Populus trichocarpa
ugccaaaggagaguugcccua

SEQ ID NO: 3149 - RNA, 21 nt, Populus trichocarpa
ugccaaaggagauuuguccgg

SEQ ID NO: 3150 - RNA, 21 nt, Populus trichocarpa
ugccaaaggagauuugcucac

SEQ ID NO: 3151 - RNA, 21 nt, Populus trichocarpa
cgccaaaggagaguugcccuc

SEQ ID NO: 3152 - RNA, 21 nt, Populus trichocarpa
uuagauucacgcacaaacucg

SEQ ID NO: 3153 - RNA, 21 nt, Populus trichocarpa
uuagauucacgcacaaacucg

SEQ ID NO: 3154 - RNA, 21 nt, Populus trichocarpa
uuagauucacgcacaaacucg

SEQ ID NO: 3155 - RNA, 21 nt, Populus trichocarpa
augcacugccucuucccuggc

SEQ ID NO: 3156 - RNA, 22 nt, Populus trichocarpa
uuuucccuacuccacccauccc

SEQ ID NO: 3157 - RNA, 22 nt, Populus trichocarpa
uuuucccaacuccacccauccc

SEQ ID NO: 3158 - RNA, 20 nt, Populus trichocarpa
acucucccucaaggcuucca

SEQ ID NO: 3159 - RNA, 20 nt, Populus trichocarpa
gcucucccucagggcuucca

SEQ ID NO: 3160 - RNA, 24 nt, Populus trichocarpa
caaaaguugcuggguuuggcuggg

SEQ ID NO: 3161 - RNA, 24 nt, Populus trichocarpa
caaaaguuguuggguuuggcuggg

SEQ ID NO: 3162 - RNA, 24 nt, Populus trichocarpa
caaaagcuguuggguuuggcuggg

SEQ ID NO: 3163 - RNA, 21 nt, Populus trichocarpa
uuacagugcccauugauuaag

SEQ ID NO: 3164 - RNA, 21 nt, Populus trichocarpa
uuacagugcccauugauuaag

SEQ ID NO: 3165 - RNA, 21 nt, Populus trichocarpa
uuacaauguccauugauuaag

SEQ ID NO: 3166 - RNA, 21 nt, Populus trichocarpa
uuacagaguccauugauuaag

SEQ ID NO: 3167 - RNA, 21 nt, Populus trichocarpa
uaguaauccuucuuugcaaag

SEQ ID NO: 3168 - RNA, 21 nt, Populus trichocarpa
uaguaauucuucuuugcaaaa

SEQ ID NO: 3169 - RNA, 21 nt, Populus trichocarpa
uaguaauucuucuuugcaaaa

SEQ ID NO: 3170 - RNA, 21 nt, Populus trichocarpa
aucucccucagaggcuuccaa

SEQ ID NO: 3171 - RNA, 21 nt, Populus trichocarpa
aucucccucagaggcuuccaa

SEQ ID NO: 3172 - RNA, 24 nt, Populus trichocarpa
ugacgugucuucuauuuuuaggga

SEQ ID NO: 3173 - RNA, 24 nt, Populus trichocarpa
ugacgugucuucuauuuuuaggga

SEQ ID NO: 3174 - RNA, 24 nt, Populus trichocarpa
ugacgugucuucuauuuuuaggga

SEQ ID NO: 3175 - RNA, 24 nt, Populus trichocarpa
ugacgugucuucuauuuuuaggaa

SEQ ID NO: 3176 - RNA, 24 nt, Populus trichocarpa
ugacgagucuucuauuuuuaggga

SEQ ID NO: 3177 - RNA, 24 nt, Populus trichocarpa
ugacaugucuucuauuuuuaggga

SEQ ID NO: 3178 - RNA, 24 nt, Populus trichocarpa
uaacgugucuccuauuuuuaggga

SEQ ID NO: 3179 - RNA, 24 nt, Populus trichocarpa
uaacgugucuccuauuuuuaggga

SEQ ID NO: 3180 - RNA, 24 nt, Populus trichocarpa
uaacgugucuccuauuuuuaggga

SEQ ID NO: 3181 - RNA, 24 nt, Populus trichocarpa
uaacgugucuccuauuuuuaggga

SEQ ID NO: 3182 - RNA, 24 nt, Populus trichocarpa
uaacgugucuccuauuuuuaggga

SEQ ID NO: 3183 - RNA, 24 nt, Populus trichocarpa
uaacgugucuccuauuuuuaggga

SEQ ID NO: 3184 - RNA, 24 nt, Populus trichocarpa
uaacgugucuccuauuuuuaggga

SEQ ID NO: 3185 - RNA, 24 nt, Populus trichocarpa
uaacgugucuccuauuuuuaggga

SEQ ID NO: 3186 - RNA, 24 nt, Populus trichocarpa
uaacgugucuccuauuuuuaggga

SEQ ID NO: 3187 - RNA, 24 nt, Populus trichocarpa
uaacgugucuccuauuuuuaggga

SEQ ID NO: 3188 - RNA, 24 nt, Populus trichocarpa
uaacgugucuccuauuuuuaggga

SEQ ID NO: 3189 - RNA, 24 nt, Populus trichocarpa
uaacgugucuccuauuuuuaggga

SEQ ID NO: 3190 - RNA, 24 nt, Populus trichocarpa
uaacgugucuccuauuuuuaggga

SEQ ID NO: 3191 - RNA, 22 nt, Populus trichocarpa
ugugauauugguccggcucauc

SEQ ID NO: 3192 - RNA, 24 nt, Populus trichocarpa
acuacuacaucauugacguugaac

SEQ ID NO: 3193 - RNA, 24 nt, Populus trichocarpa
acuacuacaucauugauguugaac

SEQ ID NO: 3194 - RNA, 24 nt, Populus trichocarpa
aggaccucacuuaacagcuuaagc

SEQ ID NO: 3195 - RNA, 24 nt, Populus trichocarpa
aggaccucacuuaacagcuuaagc

SEQ ID NO: 3196 - RNA, 24 nt, Populus trichocarpa
aggaccucacuuaacagcuuaagc

SEQ ID NO: 3197 - RNA, 24 nt, Populus trichocarpa
aagaccucaccuaacagcuuaagc

SEQ ID NO: 3198 - RNA, 24 nt, Populus trichocarpa
aggaccucaccuaacagcuuaagc

SEQ ID NO: 3199 - RNA, 17 nt, Populus trichocarpa
ccuacuccucccauucc

SEQ ID NO: 3200 - RNA, 22 nt, Pan troglodytes
aacccguagauccgaacuugug

SEQ ID NO: 3201 - RNA, 22 nt, Pan troglodytes
uacaguacugugauaacugaag

SEQ ID NO: 3202 - RNA, 23 nt, Pan troglodytes
agcagcauuguacagggcuauga

SEQ ID NO: 3203 - RNA, 20 nt, Pan troglodytes
ucaaaugcucagacuccugu

SEQ ID NO: 3204 - RNA, 24 nt, Pan troglodytes
aaaagugcuuacagugcagguagc

SEQ ID NO: 3205 - RNA, 21 nt, Pan troglodytes
uaaagugcugacagugcagau

SEQ ID NO: 3206 - RNA, 23 nt, Pan troglodytes
agcagcauuguacagggcuauca

SEQ ID NO: 3207 - RNA, 22 nt, Pan troglodytes
uuaaggcacgcggugaaugcca

SEQ ID NO: 3208 - RNA, 22 nt, Pan troglodytes
ucccugagacccuaacuuguga

SEQ ID NO: 3209 - RNA, 22 nt, Pan troglodytes
ucggauccgucugagcuuggcu

SEQ ID NO: 3210 - RNA, 22 nt, Pan troglodytes
ucacagugaaccggucucuuuu

SEQ ID NO: 3211 - RNA, 21 nt, Pan troglodytes
uugguccccuucaaccagcug

SEQ ID NO: 3212 - RNA, 23 nt, Pan troglodytes
uauggcuuuuuauuccuauguga

SEQ ID NO: 3213 - RNA, 23 nt, Pan troglodytes
acuccauuuguuuugaugaugga

SEQ ID NO: 3214 - RNA, 21 nt, Pan troglodytes
agugguuuuacccuaugguag

SEQ ID NO: 3215 - RNA, 22 nt, Pan troglodytes
ugagaugaagcacuguagcuca

SEQ ID NO: 3216 - RNA, 22 nt, Pan troglodytes
uacaguauagaugauguacuag

SEQ ID NO: 3217 - RNA, 24 nt, Pan troglodytes
guccaguuuucccaggaaucccuu

SEQ ID NO: 3218 - RNA, 20 nt, Pan troglodytes
guguguggaaaugcuucugc

SEQ ID NO: 3219 - RNA, 22 nt, Pan troglodytes
uagguuauccguguugccuucg

SEQ ID NO: 3220 - RNA, 22 nt, Pan troglodytes
uagcagcacauaaugguuugug

SEQ ID NO: 3221 - RNA, 22 nt, Pan troglodytes
uagcagcacaucaugguuuaca

SEQ ID NO: 3222 - RNA, 22 nt, Pan troglodytes
uagcagcacguaaauauuggcg

SEQ ID NO: 3223 - RNA, 20 nt, Pan troglodytes
acugcagugaaggcacuugu

SEQ ID NO: 3224 - RNA, 24 nt, Pan troglodytes
caaagugcuuacagugcagguagu

SEQ ID NO: 3225 - RNA, 22 nt, Pan troglodytes
uaaggugcaucuagugcagaua

SEQ ID NO: 3226 - RNA, 23 nt, Pan troglodytes
aacauucaacgcugucggugagu

SEQ ID NO: 3227 - RNA, 22 nt, Pan troglodytes
accaucgaccguugauuguacc

SEQ ID NO: 3228 - RNA, 24 nt, Pan troglodytes
aacauucauugcugucgguggguu

SEQ ID NO: 3229 - RNA, 22 nt, Pan troglodytes
aacauucaaccugucggugagu

SEQ ID NO: 3230 - RNA, 23 nt, Pan troglodytes
uauggcacugguagaauucacug

SEQ ID NO: 3231 - RNA, 22 nt, Pan troglodytes
uggacggagaacugauaagggu

SEQ ID NO: 3232 - RNA, 23 nt, Pan troglodytes
caaagaauucuccuuuugggcuu

SEQ ID NO: 3233 - RNA, 22 nt, Pan troglodytes
caucccuugcaugguggagggu

SEQ ID NO: 3234 - RNA, 22 nt, Pan troglodytes
ugauauguuugauauauuaggu

SEQ ID NO: 3235 - RNA, 22 nt, Pan troglodytes
uguaacagcaacuccaugugga

SEQ ID NO: 3236 - RNA, 22 nt, Pan troglodytes
uagguaguuucauguuguuggg

SEQ ID NO: 3237 - RNA, 22 nt, Pan troglodytes
uucaccaccuucuccacccagc

SEQ ID NO: 3238 - RNA, 19 nt, Pan troglodytes
gguccagaggggagauagg

SEQ ID NO: 3239 - RNA, 23 nt, Pan troglodytes
cccaguguucagacuaccuguuc

SEQ ID NO: 3240 - RNA, 23 nt, Pan troglodytes
ugugcaaaucuaugcaaaacuga

SEQ ID NO: 3241 - RNA, 23 nt, Pan troglodytes
ugugcaaauccaugcaaaacuga

SEQ ID NO: 3242 - RNA, 22 nt, Pan troglodytes
uaaagugcuuauagugcaggua

SEQ ID NO: 3243 - RNA, 22 nt, Pan troglodytes
uucccuuugucauccuaugccu

SEQ ID NO: 3244 - RNA, 22 nt, Pan troglodytes
uccuucauuccaccggagucug

SEQ ID NO: 3245 - RNA, 22 nt, Pan troglodytes
uagcuuaucagacugauguuga

SEQ ID NO: 3246 - RNA, 21 nt, Pan troglodytes
acagcaggcacagacaggcag

SEQ ID NO: 3247 - RNA, 21 nt, Pan troglodytes
augaccuaugaauugacagac

SEQ ID NO: 3248 - RNA, 21 nt, Pan troglodytes
uaaucucagcuggcaacugug

SEQ ID NO: 3249 - RNA, 21 nt, Pan troglodytes
uugugcuugaucuaaccaugu

SEQ ID NO: 3250 - RNA, 22 nt, Pan troglodytes
aagcugccaguugaagaacugu

SEQ ID NO: 3251 - RNA, 21 nt, Pan troglodytes
ccacaccguaucugacacuuu

SEQ ID NO: 3252 - RNA, 21 nt, Pan troglodytes
ugucaguuugucaaauacccc

SEQ ID NO: 3253 - RNA, 23 nt, Pan troglodytes
caagucacuagugguuccguuua

SEQ ID NO: 3254 - RNA, 21 nt, Pan troglodytes
aucacauugccagggauuucc

SEQ ID NO: 3255 - RNA, 23 nt, Pan troglodytes
aucacauugccagggauuaccac

SEQ ID NO: 3256 - RNA, 22 nt, Pan troglodytes
uggcucaguucagcaggaacag

SEQ ID NO: 3257 - RNA, 22 nt, Pan troglodytes
cauugcacuugucucggucuga

SEQ ID NO: 3258 - RNA, 22 nt, Pan troglodytes
uucaaguaauccaggauaggcu

SEQ ID NO: 3259 - RNA, 22 nt, Pan troglodytes
uucacaguggcuaaguuccgcc

SEQ ID NO: 3260 - RNA, 22 nt, Pan troglodytes
aaggagcucacagucuauugag

SEQ ID NO: 3261 - RNA, 22 nt, Pan troglodytes
cuagcaccaucugaaaucgguu

SEQ ID NO: 3262 - RNA, 20 nt, Pan troglodytes
uagcaccauuugaaaucagu

SEQ ID NO: 3263 - RNA, 22 nt, Pan troglodytes
cuuucagucggauguuugcagc

SEQ ID NO: 3264 - RNA, 22 nt, Pan troglodytes
uguaaacauccucgacuggaag

SEQ ID NO: 3265 - RNA, 21 nt, Pan troglodytes
uguaaacauccuacacucagc

SEQ ID NO: 3266 - RNA, 23 nt, Pan troglodytes
uguaaacauccuacacucucagc

SEQ ID NO: 3267 - RNA, 22 nt, Pan troglodytes
uguaaacauccccgacuggaag

SEQ ID NO: 3268 - RNA, 21 nt, Pan troglodytes
ggcaagaugcuggcauagcug

SEQ ID NO: 3269 - RNA, 21 nt, Pan troglodytes
uauugcacauuacuaaguugc

SEQ ID NO: 3270 - RNA, 19 nt, Pan troglodytes
gugcauuguaguugcauug

SEQ ID NO: 3271 - RNA, 22 nt, Pan troglodytes
uggcagugucuuagcugguugu

SEQ ID NO: 3272 - RNA, 21 nt, Pan troglodytes
uggaagacuagugauuuuguu

SEQ ID NO: 3273 - RNA, 23 nt, Pan troglodytes
ucuuugguuaucuagcuguauga

SEQ ID NO: 3274 - RNA, 22 nt, Pan troglodytes
uauugcacuugucccggccugu

SEQ ID NO: 3275 - RNA, 22 nt, Pan troglodytes
aaagugcuguucgugcagguag

SEQ ID NO: 3276 - RNA, 22 nt, Pan troglodytes
uucaacggguauuuauugagca

SEQ ID NO: 3277 - RNA, 22 nt, Pan troglodytes
uuuggcacuagcacauuuuugc

SEQ ID NO: 3278 - RNA, 22 nt, Pan troglodytes
ugagguaguaaguuguauuguu

SEQ ID NO: 3279 - RNA, 22 nt, Pan troglodytes
aacccguagauccgaucuugug

SEQ ID NO: 3280 - RNA, 22 nt, Rhesus lymphocryptovirus
uaaccugaucagccccgggguu

SEQ ID NO: 3281 - RNA, 22 nt, Rhesus lymphocryptovirus
uagugcgccggugaccugauag

SEQ ID NO: 3282 - RNA, 22 nt, Rhesus lymphocryptovirus
ugacacucgauaggauacgggg

SEQ ID NO: 3283 - RNA, 22 nt, Rhesus lymphocryptovirus
aacggugcauggacuggcuaga

SEQ ID NO: 3284 - RNA, 22 nt, Rhesus lymphocryptovirus
agaccagaccaugcacaguggg

SEQ ID NO: 3285 - RNA, 22 nt, Rhesus lymphocryptovirus
gaucauagccaguguccaggga

SEQ ID NO: 3286 - RNA, 21 nt, Rhesus lymphocryptovirus
ucgcacaucaggcugaacgac

SEQ ID NO: 3287 - RNA, 23 nt, Rhesus lymphocryptovirus
ucggacggucuggugcgcuugau

SEQ ID NO: 3288 - RNA, 24 nt, Rhesus lymphocryptovirus
uccuguagaguaugggugugguuu

SEQ ID NO: 3289 - RNA, 22 nt, Rhesus lymphocryptovirus
caugaaacacauggccuguucc

SEQ ID NO: 3290 - RNA, 20 nt, Rhesus lymphocryptovirus
agcaggcaugucuucauucc

SEQ ID NO: 3291 - RNA, 23 nt, Rhesus lymphocryptovirus
uaucuuuugcgggggaauuucca

SEQ ID NO: 3292 - RNA, 23 nt, Rhesus lymphocryptovirus
cgcaccucgccgucucuacugcu

SEQ ID NO: 3293 - RNA, 22 nt, Rhesus lymphocryptovirus
caccacacgauccacuaggucu

SEQ ID NO: 3294 - RNA, 21 nt, Rhesus lymphocryptovirus
accuaguaauugugcgguguu

SEQ ID NO: 3295 - RNA, 22 nt, Rhesus lymphocryptovirus
cgcaccacuuuucacuaggugu

SEQ ID NO: 3296 - RNA, 22 nt, Rhesus lymphocryptovirus
aaccuagugccggugaugugcu

SEQ ID NO: 3297 - RNA, 22 nt, Rhesus lymphocryptovirus
uagcaccgcuauccacuauguc

SEQ ID NO: 3298 - RNA, 23 nt, Rhesus lymphocryptovirus
uuuaguggaagugacgugcugug

SEQ ID NO: 3299 - RNA, 22 nt, Rhesus lymphocryptovirus
cgagguaaacaucggcuuacug

SEQ ID NO: 3300 - RNA, 24 nt, Rhesus lymphocryptovirus
uaaggugaauauagcugcccauug

SEQ ID NO: 3301 - RNA, 23 nt, Rhesus lymphocryptovirus
ucgaugcaugguccccccuuagu

SEQ ID NO: 3302 - RNA, 22 nt, Rattus norvegicus
ugagguaguagguuguauaguu

SEQ ID NO: 3303 - RNA, 22 nt, Rattus norvegicus
ugagguaguagguugugugguu

SEQ ID NO: 3304 - RNA, 22 nt, Rattus norvegicus
ugagguaguagguuguaugguu

SEQ ID NO: 3305 - RNA, 21 nt, Rattus norvegicus
agagguaguagguugcauagu

SEQ ID NO: 3306 - RNA, 22 nt, Rattus norvegicus
cuauacgaccugcugccuuucu

SEQ ID NO: 3307 - RNA, 21 nt, Rattus norvegicus
ugagguaggagguuguauagu

SEQ ID NO: 3308 - RNA, 22 nt, Rattus norvegicus
ugagguaguagauuguauaguu

SEQ ID NO: 3309 - RNA, 21 nt, Rattus norvegicus
ugagguaguaguuugugcugu

SEQ ID NO: 3310 - RNA, 21 nt, Rattus norvegicus
uggaauguaaagaagugugua

SEQ ID NO: 3311 - RNA, 22 nt, Rattus norvegicus
gcacauacuucuuuauguaccc

SEQ ID NO: 3312 - RNA, 22 nt, Rattus norvegicus
aacccguagauccgaacuugug

SEQ ID NO: 3313 - RNA, 22 nt, Rattus norvegicus
uacaguacugugauaacugaag

SEQ ID NO: 3314 - RNA, 22 nt, Rattus norvegicus
uacaguacugugauagcugaag

SEQ ID NO: 3315 - RNA, 23 nt, Rattus norvegicus
agcagcauuguacagggcuauga

SEQ ID NO: 3316 - RNA, 21 nt, Rattus norvegicus
uaaagugcugacagugcagau

SEQ ID NO: 3317 - RNA, 23 nt, Rattus norvegicus
agcagcauuguacagggcuauca

SEQ ID NO: 3318 - RNA, 23 nt, Rattus norvegicus
uacccuguagauccgaauuugug

SEQ ID NO: 3319 - RNA, 22 nt, Rattus norvegicus
cccuguagaaccgaauuugugu

SEQ ID NO: 3320 - RNA, 23 nt, Rattus norvegicus
uggagugugacaaugguguuugu

SEQ ID NO: 3321 - RNA, 22 nt, Rattus norvegicus
uuaaggcacgcggugaaugcca

SEQ ID NO: 3322 - RNA, 23 nt, Rattus norvegicus
ucccugagacccuuuaaccugug

SEQ ID NO: 3323 - RNA, 22 nt, Rattus norvegicus
ucccugagacccuaacuuguga

SEQ ID NO: 3324 - RNA, 21 nt, Rattus norvegicus
ucguaccgugaguaauaaugc

SEQ ID NO: 3325 - RNA, 21 nt, Rattus norvegicus
cauuauuacuuuugguacgcg

SEQ ID NO: 3326 - RNA, 22 nt, Rattus norvegicus
ucggauccgucugagcuuggcu

SEQ ID NO: 3327 - RNA, 22 nt, Rattus norvegicus
ucacagugaaccggucucuuuu

SEQ ID NO: 3328 - RNA, 22 nt, Rattus norvegicus
ucacagugaaccggucucuuuc

SEQ ID NO: 3329 - RNA, 22 nt, Rattus norvegicus
cuuuuugcggucugggcuugcu

SEQ ID NO: 3330 - RNA, 22 nt, Rattus norvegicus
aagcccuuaccccaaaaagcau

SEQ ID NO: 3331 - RNA, 22 nt, Rattus norvegicus
cagugcaauguuaaaagggcau

SEQ ID NO: 3332 - RNA, 22 nt, Rattus norvegicus
cagugcaaugaugaaagggcau

SEQ ID NO: 3333 - RNA, 22 nt, Rattus norvegicus
uaacagucuacagccauggucg

SEQ ID NO: 3334 - RNA, 22 nt, Rattus norvegicus
uugguccccuucaaccagcugu

SEQ ID NO: 3335 - RNA, 21 nt, Rattus norvegicus
uugguccccuucaaccagcua

SEQ ID NO: 3336 - RNA, 21 nt, Rattus norvegicus
ugugacugguugaccagaggg

SEQ ID NO: 3337 - RNA, 23 nt, Rattus norvegicus
uauggcuuuuuauuccuauguga

SEQ ID NO: 3338 - RNA, 22 nt, Rattus norvegicus
uauggcuuuucauuccuaugug

SEQ ID NO: 3339 - RNA, 23 nt, Rattus norvegicus
acuccauuuguuuugaugaugga

SEQ ID NO: 3340 - RNA, 22 nt, Rattus norvegicus
uauugcuuaagaauacgcguag

SEQ ID NO: 3341 - RNA, 17 nt, Rattus norvegicus
agcugguguugugaauc

SEQ ID NO: 3342 - RNA, 18 nt, Rattus norvegicus
ucuacagugcacgugucu

SEQ ID NO: 3343 - RNA, 21 nt, Rattus norvegicus
agugguuuuacccuaugguag

SEQ ID NO: 3344 - RNA, 24 nt, Rattus norvegicus
uaccacaggguagaaccacggaca

SEQ ID NO: 3345 - RNA, 22 nt, Rattus norvegicus
uaacacugucugguaaagaugg

SEQ ID NO: 3346 - RNA, 23 nt, Rattus norvegicus
uguaguguuuccuacuuuaugga

SEQ ID NO: 3347 - RNA, 20 nt, Rattus norvegicus
cauaaaguagaaagcacuac

SEQ ID NO: 3348 - RNA, 22 nt, Rattus norvegicus
ugagaugaagcacuguagcuca

SEQ ID NO: 3349 - RNA, 22 nt, Rattus norvegicus
uacaguauagaugauguacuag

SEQ ID NO: 3350 - RNA, 24 nt, Rattus norvegicus
guccaguuuucccaggaaucccuu

SEQ ID NO: 3351 - RNA, 22 nt, Rattus norvegicus
ugagaacugaauuccauggguu

SEQ ID NO: 3352 - RNA, 22 nt, Rattus norvegicus
ucagugcaucacagaacuuugu

SEQ ID NO: 3353 - RNA, 22 nt, Rattus norvegicus
ucucccaacccuuguaccagug

SEQ ID NO: 3354 - RNA, 22 nt, Rattus norvegicus
acuagacugaggcuccuugagg

SEQ ID NO: 3355 - RNA, 22 nt, Rattus norvegicus
ucgaggagcucacagucuagua

SEQ ID NO: 3356 - RNA, 22 nt, Rattus norvegicus
ucagugcaugacagaacuuggg

SEQ ID NO: 3357 - RNA, 20 nt, Rattus norvegicus
uugcauagucacaaaaguga

SEQ ID NO: 3358 - RNA, 22 nt, Rattus norvegicus
uagguuauccguguugccuucg

SEQ ID NO: 3359 - RNA, 22 nt, Rattus norvegicus
uagcagcacaucaugguuuaca

SEQ ID NO: 3360 - RNA, 22 nt, Rattus norvegicus
uagcagcacguaaauauuggcg

SEQ ID NO: 3361 - RNA, 24 nt, Rattus norvegicus
caaagugcuuacagugcagguagu

SEQ ID NO: 3362 - RNA, 22 nt, Rattus norvegicus
uaaggugcaucuagugcagaua

SEQ ID NO: 3363 - RNA, 23 nt, Rattus norvegicus
aacauucaacgcugucggugagu

SEQ ID NO: 3364 - RNA, 22 nt, Rattus norvegicus
accaucgaccguugauuguacc

SEQ ID NO: 3365 - RNA, 22 nt, Rattus norvegicus
aacauucauugcugucgguggg

SEQ ID NO: 3366 - RNA, 22 nt, Rattus norvegicus
aacauucaaccugucggugagu

SEQ ID NO: 3367 - RNA, 23 nt, Rattus norvegicus
uauggcacugguagaauucacug

SEQ ID NO: 3368 - RNA, 22 nt, Rattus norvegicus
uggacggagaacugauaagggu

SEQ ID NO: 3369 - RNA, 18 nt, Rattus norvegicus
uggagagaaaggcaguuc

SEQ ID NO: 3370 - RNA, 23 nt, Rattus norvegicus
caaagaauucuccuuuugggcuu

SEQ ID NO: 3371 - RNA, 21 nt, Rattus norvegicus
ucgugucuuguguugcagccg

SEQ ID NO: 3372 - RNA, 23 nt, Rattus norvegicus
gugccuacugagcugauaucagu

SEQ ID NO: 3373 - RNA, 22 nt, Rattus norvegicus
ugauauguuugauauauuaggu

SEQ ID NO: 3374 - RNA, 22 nt, Rattus norvegicus
caacggaaucccaaaagcagcu

SEQ ID NO: 3375 - RNA, 21 nt, Rattus norvegicus
cugaccuaugaauugacagcc

SEQ ID NO: 3376 - RNA, 21 nt, Rattus norvegicus
aacuggccuacaaagucccag

SEQ ID NO: 3377 - RNA, 22 nt, Rattus norvegicus
uguaacagcaacuccaugugga

SEQ ID NO: 3378 - RNA, 21 nt, Rattus norvegicus
uagcagcacagaaauauuggc

SEQ ID NO: 3379 - RNA, 21 nt, Rattus norvegicus
uagguaguuucauguuguugg

SEQ ID NO: 3380 - RNA, 21 nt, Rattus norvegicus
uagguaguuuccuguuguugg

SEQ ID NO: 3381 - RNA, 23 nt, Rattus norvegicus
cccaguguucagacuaccuguuc

SEQ ID NO: 3382 - RNA, 23 nt, Rattus norvegicus
ugugcaaaucuaugcaaaacuga

SEQ ID NO: 3383 - RNA, 23 nt, Rattus norvegicus
ugugcaaauccaugcaaaacuga

SEQ ID NO: 3384 - RNA, 22 nt, Rattus norvegicus
uaacacugucugguaacgaugu

SEQ ID NO: 3385 - RNA, 23 nt, Rattus norvegicus
uaauacugccugguaaugaugac

SEQ ID NO: 3386 - RNA, 22 nt, Rattus norvegicus
uaauacugccggguaaugaugg

SEQ ID NO: 3387 - RNA, 22 nt, Rattus norvegicus
gugaaauguuuaggaccacuag

SEQ ID NO: 3388 - RNA, 22 nt, Rattus norvegicus
uucccuuugucauccuaugccu

SEQ ID NO: 3389 - RNA, 22 nt, Rattus norvegicus
uccuucauuccaccggagucug

SEQ ID NO: 3390 - RNA, 22 nt, Rattus norvegicus
uggaauguaaggaagugugugg

SEQ ID NO: 3391 - RNA, 23 nt, Rattus norvegicus
gcuucuccuggcucuccucccuu

SEQ ID NO: 3392 - RNA, 22 nt, Rattus norvegicus
auaagacgagcaaaaagcuugu

SEQ ID NO: 3393 - RNA, 23 nt, Rattus norvegicus
uaaagugcuuauagugcagguag

SEQ ID NO: 3394 - RNA, 21 nt, Rattus norvegicus
acugcauuacgagcacuuaca

SEQ ID NO: 3395 - RNA, 21 nt, Rattus norvegicus
caaagugcucauagugcaggu

SEQ ID NO: 3396 - RNA, 21 nt, Rattus norvegicus
acugcagugugagcacuucug

SEQ ID NO: 3397 - RNA, 22 nt, Rattus norvegicus
uagcuuaucagacugauguuga

SEQ ID NO: 3398 - RNA, 22 nt, Rattus norvegicus
cugugcgugugacagcggcuga

SEQ ID NO: 3399 - RNA, 22 nt, Rattus norvegicus
uucccuuugucauccuuugccu

SEQ ID NO: 3400 - RNA, 21 nt, Rattus norvegicus
uaacagucuccagucacggcc

SEQ ID NO: 3401 - RNA, 21 nt, Rattus norvegicus
acagcaggcacagacaggcag

SEQ ID NO: 3402 - RNA, 21 nt, Rattus norvegicus
augaccuaugauuugacagac

SEQ ID NO: 3403 - RNA, 21 nt, Rattus norvegicus
uaaucucagcuggcaacugug

SEQ ID NO: 3404 - RNA, 24 nt, Rattus norvegicus
uacugcaucaggaacugacuggau

SEQ ID NO: 3405 - RNA, 21 nt, Rattus norvegicus
uugugcuugaucuaaccaugu

SEQ ID NO: 3406 - RNA, 21 nt, Rattus norvegicus
ugauuguccaaacgcaauucu

SEQ ID NO: 3407 - RNA, 22 nt, Rattus norvegicus
aagcugccaguugaagaacugu

SEQ ID NO: 3408 - RNA, 21 nt, Rattus norvegicus
aguucuucaguggcaagcuuu

SEQ ID NO: 3409 - RNA, 23 nt, Rattus norvegicus
agcuacauugucugcuggguuuc

SEQ ID NO: 3410 - RNA, 24 nt, Rattus norvegicus
agcuacaucuggcuacugggucuc

SEQ ID NO: 3411 - RNA, 21 nt, Rattus norvegicus
ugucaguuugucaaauacccc

SEQ ID NO: 3412 - RNA, 23 nt, Rattus norvegicus
caagucacuagugguuccguuua

SEQ ID NO: 3413 - RNA, 21 nt, Rattus norvegicus
aucacauugccagggauuucc

SEQ ID NO: 3414 - RNA, 21 nt, Rattus norvegicus
aucacauugccagggauuacc

SEQ ID NO: 3415 - RNA, 22 nt, Rattus norvegicus
uggcucaguucagcaggaacag

SEQ ID NO: 3416 - RNA, 22 nt, Rattus norvegicus
cauugcacuugucucggucuga

SEQ ID NO: 3417 - RNA, 21 nt, Rattus norvegicus
uucaaguaauccaggauaggc

SEQ ID NO: 3418 - RNA, 22 nt, Rattus norvegicus
uucaaguaauucaggauagguu

SEQ ID NO: 3419 - RNA, 21 nt, Rattus norvegicus
uucacaguggcuaaguuccgc

SEQ ID NO: 3420 - RNA, 21 nt, Rattus norvegicus
uucacaguggcuaaguucugc

SEQ ID NO: 3421 - RNA, 22 nt, Rattus norvegicus
aaggagcucacagucuauugag

SEQ ID NO: 3422 - RNA, 23 nt, Rattus norvegicus
cucaaacuaugggggcacuuuuu

SEQ ID NO: 3423 - RNA, 23 nt, Rattus norvegicus
aaagugcuuccacuuugugugcc

SEQ ID NO: 3424 - RNA, 22 nt, Rattus norvegicus
caucaaaguggaggcccucucu

SEQ ID NO: 3425 - RNA, 23 nt, Rattus norvegicus
aagugccgccagguuuugagugu

SEQ ID NO: 3426 - RNA, 22 nt, Rattus norvegicus
acucaaacugggggcucuuuug

SEQ ID NO: 3427 - RNA, 21 nt, Rattus norvegicus
agggcccccccucaauccugu

SEQ ID NO: 3428 - RNA, 23 nt, Rattus norvegicus
auguaugugugcauguaugcaug

SEQ ID NO: 3429 - RNA, 22 nt, Rattus norvegicus
ggcagaggagggcuguucuucc

SEQ ID NO: 3430 - RNA, 22 nt, Rattus norvegicus
ugguuuaccgucccacauacau

SEQ ID NO: 3431 - RNA, 21 nt, Rattus norvegicus
uagcaccaucugaaaucgguu

SEQ ID NO: 3432 - RNA, 23 nt, Rattus norvegicus
uagcaccauuugaaaucaguguu

SEQ ID NO: 3433 - RNA, 20 nt, Rattus norvegicus
uagcaccauuugaaaucggu

SEQ ID NO: 3434 - RNA, 22 nt, Rattus norvegicus
ugaccgauuucuccugguguuc

SEQ ID NO: 3435 - RNA, 22 nt, Rattus norvegicus
uaugcaagggcaagcucucuuc

SEQ ID NO: 3436 - RNA, 25 nt, Rattus norvegicus
cagugcaauaguauugucaaagcau

SEQ ID NO: 3437 - RNA, 22 nt, Rattus norvegicus
cuuucagucggauguuugcagc

SEQ ID NO: 3438 - RNA, 22 nt, Rattus norvegicus
uguaaacauccucgacuggaag

SEQ ID NO: 3439 - RNA, 22 nt, Rattus norvegicus
uguaaacauccuacacucagcu

SEQ ID NO: 3440 - RNA, 23 nt, Rattus norvegicus
uguaaacauccuacacucucagc

SEQ ID NO: 3441 - RNA, 22 nt, Rattus norvegicus
uguaaacauccccgacuggaag

SEQ ID NO: 3442 - RNA, 20 nt, Rattus norvegicus
uguaaacauccuugacugga

SEQ ID NO: 3443 - RNA, 22 nt, Rattus norvegicus
aggcaagaugcuggcauagcug

SEQ ID NO: 3444 - RNA, 21 nt, Rattus norvegicus
uauugcacauuacuaaguugc

SEQ ID NO: 3445 - RNA, 23 nt, Rattus norvegicus
aaaagcuggguugagagggcgaa

SEQ ID NO: 3446 - RNA, 20 nt, Rattus norvegicus
aaacaugaagcgcugcaaca

SEQ ID NO: 3447 - RNA, 22 nt, Rattus norvegicus
gcacauuacacggucgaccucu

SEQ ID NO: 3448 - RNA, 22 nt, Rattus norvegicus
ccacugccccaggugcugcugg

SEQ ID NO: 3449 - RNA, 23 nt, Rattus norvegicus
cgcauccccuagggcauuggugu

SEQ ID NO: 3450 - RNA, 23 nt, Rattus norvegicus
ccuaguaggugcucaguaagugu

SEQ ID NO: 3451 - RNA, 21 nt, Rattus norvegicus
ccucugggcccuuccuccagu

SEQ ID NO: 3452 - RNA, 19 nt, Rattus norvegicus
ccuugaggggcaugagggu

SEQ ID NO: 3453 - RNA, 22 nt, Rattus norvegicus
cuggcccucucugcccuuccgu

SEQ ID NO: 3454 - RNA, 22 nt, Rattus norvegicus
aacacacccagcuaaccuuuuu

SEQ ID NO: 3455 - RNA, 19 nt, Rattus norvegicus
gugcauuguaguugcauug

SEQ ID NO: 3456 - RNA, 23 nt, Rattus norvegicus
gcaaagcacagggccugcagaga

SEQ ID NO: 3457 - RNA, 21 nt, Rattus norvegicus
gccccugggccuauccuagaa

SEQ ID NO: 3458 - RNA, 20 nt, Rattus norvegicus
guggugugcuaguuacuuuu

SEQ ID NO: 3459 - RNA, 23 nt, Rattus norvegicus
ucaagagcaauaacgaaaaaugu

SEQ ID NO: 3460 - RNA, 21 nt, Rattus norvegicus
ucacccuuccauaucuagucu

SEQ ID NO: 3461 - RNA, 23 nt, Rattus norvegicus
uucagcuccuauaugaugccuuu

SEQ ID NO: 3462 - RNA, 23 nt, Rattus norvegicus
uccagcaucagugauuuuguuga

SEQ ID NO: 3463 - RNA, 21 nt, Rattus norvegicus
ucccuguccuccaggagcuca

SEQ ID NO: 3464 - RNA, 23 nt, Rattus norvegicus
uccgucucaguuacuuuauagcc

SEQ ID NO: 3465 - RNA, 21 nt, Rattus norvegicus
ucgaucggucggucggucagu

SEQ ID NO: 3466 - RNA, 24 nt, Rattus norvegicus
ucucacacagaaaucgcacccguc

SEQ ID NO: 3467 - RNA, 20 nt, Rattus norvegicus
ucucccuccgugugcccaga

SEQ ID NO: 3468 - RNA, 23 nt, Rattus norvegicus
ugaucuagccaaagccugaccgu

SEQ ID NO: 3469 - RNA, 21 nt, Rattus norvegicus
ugcugaccccuaguccagugc

SEQ ID NO: 3470 - RNA, 23 nt, Rattus norvegicus
ugucugccugagugccugccucu

SEQ ID NO: 3471 - RNA, 19 nt, Rattus norvegicus
ugucccucugggucgccca

SEQ ID NO: 3472 - RNA, 22 nt, Rattus norvegicus
cagcccugcugucuuaaccucu

SEQ ID NO: 3473 - RNA, 23 nt, Rattus norvegicus
uggcagugucuuagcugguuguu

SEQ ID NO: 3474 - RNA, 23 nt, Rattus norvegicus
uaggcaguguaauuagcugauug

SEQ ID NO: 3475 - RNA, 23 nt, Rattus norvegicus
aggcaguguaguuagcugauugc

SEQ ID NO: 3476 - RNA, 24 nt, Rattus norvegicus
uucacaaagcccauacacuuucac

SEQ ID NO: 3477 - RNA, 24 nt, Rattus norvegicus
ucccugaggagcccuuugagccug

SEQ ID NO: 3478 - RNA, 21 nt, Rattus norvegicus
agaguaguagguugcauagua

SEQ ID NO: 3479 - RNA, 22 nt, Rattus norvegicus
uuaucagaaucuccagggguac

SEQ ID NO: 3480 - RNA, 21 nt, Rattus norvegicus
aauugcacgguauccaucugu

SEQ ID NO: 3481 - RNA, 22 nt, Rattus norvegicus
cggguggaucacgaugcaauuu

SEQ ID NO: 3482 - RNA, 22 nt, Rattus norvegicus
uaaugccccuaaaaauccuuau

SEQ ID NO: 3483 - RNA, 20 nt, Rattus norvegicus
aauaauacaugguugaucuu

SEQ ID NO: 3484 - RNA, 21 nt, Rattus norvegicus
agaucgaccguguuauauucg

SEQ ID NO: 3485 - RNA, 23 nt, Rattus norvegicus
gccugcugggguggaaccugguu

SEQ ID NO: 3486 - RNA, 22 nt, Rattus norvegicus
auauaauacaaccugcuaagug

SEQ ID NO: 3487 - RNA, 20 nt, Rattus norvegicus
aucguagaggaaaauccacg

SEQ ID NO: 3488 - RNA, 21 nt, Rattus norvegicus
gguagauucuccuucuaugag

SEQ ID NO: 3489 - RNA, 20 nt, Rattus norvegicus
aucauagaggaacauccacu

SEQ ID NO: 3490 - RNA, 21 nt, Rattus norvegicus
guggauauuccuucuaugguu

SEQ ID NO: 3491 - RNA, 20 nt, Rattus norvegicus
aacauagaggaaauuucacg

SEQ ID NO: 3492 - RNA, 22 nt, Rattus norvegicus
aucacacaaaggcaacuuuugg

SEQ ID NO: 3493 - RNA, 22 nt, Rattus norvegicus
cuccugacuccagguccugugu

SEQ ID NO: 3494 - RNA, 19 nt, Rattus norvegicus
ugguagacuauggaacgua

SEQ ID NO: 3495 - RNA, 19 nt, Rattus norvegicus
uauacaagggcaagcucuc

SEQ ID NO: 3496 - RNA, 21 nt, Rattus norvegicus
gaaguuguucgugguggauuc

SEQ ID NO: 3497 - RNA, 21 nt, Rattus norvegicus
aaucauucacggacaacacuu

SEQ ID NO: 3498 - RNA, 22 nt, Rattus norvegicus
agaucagaaggugacuguggcu

SEQ ID NO: 3499 - RNA, 20 nt, Rattus norvegicus
aauguugcucggugaacccc

SEQ ID NO: 3500 - RNA, 20 nt, Rattus norvegicus
agguuacccgagcaacuuug

SEQ ID NO: 3501 - RNA, 23 nt, Rattus norvegicus
acuucaccugguccacuagccgu

SEQ ID NO: 3502 - RNA, 21 nt, Rattus norvegicus
ggccucauuaaauguuuguug

SEQ ID NO: 3503 - RNA, 22 nt, Rattus norvegicus
acuggacuuggagucagaaggc

SEQ ID NO: 3504 - RNA, 22 nt, Rattus norvegicus
cagcagcaauucauguuuugga

SEQ ID NO: 3505 - RNA, 22 nt, Rattus norvegicus
uaauacugucugguaaugccgu

SEQ ID NO: 3506 - RNA, 21 nt, Rattus norvegicus
ugucuugcaggccgucaugca

SEQ ID NO: 3507 - RNA, 22 nt, Rattus norvegicus
aucaugaugggcuccucggugu

SEQ ID NO: 3508 - RNA, 22 nt, Rattus norvegicus
uugcauauguaggaugucccau

SEQ ID NO: 3509 - RNA, 22 nt, Rattus norvegicus
uggcaguguauuguuagcuggu

SEQ ID NO: 3510 - RNA, 22 nt, Rattus norvegicus
uuuuugcgauguguuccuaaug

SEQ ID NO: 3511 - RNA, 22 nt, Rattus norvegicus
aaaccguuaccauuacugaguu

SEQ ID NO: 3512 - RNA, 23 nt, Rattus norvegicus
ucacuccuccccucccgucuugu

SEQ ID NO: 3513 - RNA, 22 nt, Rattus norvegicus
agaggcuggccgugaugaauuc

SEQ ID NO: 3514 - RNA, 21 nt, Rattus norvegicus
aaucguacagggucauccacu

SEQ ID NO: 3515 - RNA, 23 nt, Rattus norvegicus
aaugacaucacauauauggcagc

SEQ ID NO: 3516 - RNA, 21 nt, Rattus norvegicus
ugaaggucuacugugugccag

SEQ ID NO: 3517 - RNA, 21 nt, Rattus norvegicus
ugaaacauacacgggaaaccu

SEQ ID NO: 3518 - RNA, 22 nt, Rattus norvegicus
cagcagcacacugugguuugua

SEQ ID NO: 3519 - RNA, 21 nt, Rattus norvegicus
uuaagacuugcagugauguuu

SEQ ID NO: 3520 - RNA, 22 nt, Rattus norvegicus
aauccuuugucccugggugaaa

SEQ ID NO: 3521 - RNA, 20 nt, Rattus norvegicus
uagcagcgggaacaguacug

SEQ ID NO: 3522 - RNA, 20 nt, Rattus norvegicus
gucaacacuugcugguuucc

SEQ ID NO: 3523 - RNA, 22 nt, Rattus norvegicus
ggagaaauuauccuuggugugu

SEQ ID NO: 3524 - RNA, 20 nt, Rattus norvegicus
aggucagaggucgauccugg

SEQ ID NO: 3525 - RNA, 23 nt, Rattus norvegicus
aagggauucugauguuggucaca

SEQ ID NO: 3526 - RNA, 21 nt, Rattus norvegicus
ugugacagauugauaacugaa

SEQ ID NO: 3527 - RNA, 21 nt, Rattus norvegicus
cucggggaucaucaugucacg

SEQ ID NO: 3528 - RNA, 21 nt, Rattus norvegicus
aaacauucgcggugcacuucu

SEQ ID NO: 3529 - RNA, 22 nt, Rattus norvegicus
uauucauuuacuccccagccua

SEQ ID NO: 3530 - RNA, 21 nt, Rattus norvegicus
uggaagacuagugauuuuguu

SEQ ID NO: 3531 - RNA, 22 nt, Rattus norvegicus
caacaaaucacagucugccaua

SEQ ID NO: 3532 - RNA, 21 nt, Rattus norvegicus
uggaagacuugugauuuuguu

SEQ ID NO: 3533 - RNA, 23 nt, Rattus norvegicus
ucuuugguuaucuagcuguauga

SEQ ID NO: 3534 - RNA, 21 nt, Rattus norvegicus
uauugcacuugucccggccug

SEQ ID NO: 3535 - RNA, 23 nt, Rattus norvegicus
caaagugcuguucgugcagguag

SEQ ID NO: 3536 - RNA, 23 nt, Rattus norvegicus
uuuggcacuagcacauuuuugcu

SEQ ID NO: 3537 - RNA, 22 nt, Rattus norvegicus
ugagguaguaaguuguauuguu

SEQ ID NO: 3538 - RNA, 22 nt, Rattus norvegicus
aacccguagauccgaucuugug

SEQ ID NO: 3539 - RNA, 22 nt, Rattus norvegicus
cacccguagaaccgaccuugcg

SEQ ID NO: 3540 - RNA, 20 nt, Sorghum bicolor
ugacagaagagagugagcac

SEQ ID NO: 3541 - RNA, 20 nt, Sorghum bicolor
ugacagaagagagugagcac

SEQ ID NO: 3542 - RNA, 20 nt, Sorghum bicolor
ugacagaagagagugagcac

SEQ ID NO: 3543 - RNA, 21 nt, Sorghum bicolor
ugacagaagagagagagcaca

SEQ ID NO: 3544 - RNA, 20 nt, Sorghum bicolor
ugacagaagagagcgagcac

SEQ ID NO: 3545 - RNA, 21 nt, Sorghum bicolor
uuuggauugaagggagcucug

SEQ ID NO: 3546 - RNA, 21 nt, Sorghum bicolor
cuuggauugaagggagcuccu

SEQ ID NO: 3547 - RNA, 21 nt, Sorghum bicolor
ugccuggcucccuguaugcca

SEQ ID NO: 3548 - RNA, 21 nt, Sorghum bicolor
ugccuggcucccuguaugcca

SEQ ID NO: 3549 - RNA, 21 nt, Sorghum bicolor
ugccuggcucccuguaugcca

SEQ ID NO: 3550 - RNA, 21 nt, Sorghum bicolor
ugccuggcucccuguaugcca

SEQ ID NO: 3551 - RNA, 21 nt, Sorghum bicolor
ugccuggcucccuguaugcca

SEQ ID NO: 3552 - RNA, 21 nt, Sorghum bicolor
uggagaagcagggcacgugca

SEQ ID NO: 3553 - RNA, 21 nt, Sorghum bicolor
uggagaagcagggcacgugcu

SEQ ID NO: 3554 - RNA, 21 nt, Sorghum bicolor
uggagaagcaggacacgugag

SEQ ID NO: 3555 - RNA, 20 nt, Sorghum bicolor
ucggaccaggcuucauuccc

SEQ ID NO: 3556 - RNA, 20 nt, Sorghum bicolor
ucggaccaggcuucauuccc

SEQ ID NO: 3557 - RNA, 20 nt, Sorghum bicolor
ucggaccaggcuucauuccc

SEQ ID NO: 3558 - RNA, 20 nt, Sorghum bicolor
ucggaccaggcuucauuccc

SEQ ID NO: 3559 - RNA, 21 nt, Sorghum bicolor
ucggaccaggcuucaaucccu

SEQ ID NO: 3560 - RNA, 21 nt, Sorghum bicolor
ucggaccaggcuucauuccuc

SEQ ID NO: 3561 - RNA, 21 nt, Sorghum bicolor
ucggaccaggcuucaaucccu

SEQ ID NO: 3562 - RNA, 21 nt, Sorghum bicolor
ugaagcugccagcaugaucua

SEQ ID NO: 3563 - RNA, 21 nt, Sorghum bicolor
ugaagcugccagcaugaucua

SEQ ID NO: 3564 - RNA, 21 nt, Sorghum bicolor
ugaagcugccagcaugaucug

SEQ ID NO: 3565 - RNA, 21 nt, Sorghum bicolor
ugaagcugccagcaugaucug

SEQ ID NO: 3566 - RNA, 21 nt, Sorghum bicolor
ugaagcugccagcaugaucug

SEQ ID NO: 3567 - RNA, 21 nt, Sorghum bicolor
ugaagcugccagcaugaucug

SEQ ID NO: 3568 - RNA, 21 nt, Sorghum bicolor
ugaagcugccagcaugaucug

SEQ ID NO: 3569 - RNA, 21 nt, Sorghum bicolor
ucgcuuggugcagaucgggac

SEQ ID NO: 3570 - RNA, 21 nt, Sorghum bicolor
cagccaaggaugacuugccga

SEQ ID NO: 3571 - RNA, 21 nt, Sorghum bicolor
cagccaaggaugacuugccgg

SEQ ID NO: 3572 - RNA, 21 nt, Sorghum bicolor
uagccaaggaugacuugccua

SEQ ID NO: 3573 - RNA, 21 nt, Sorghum bicolor
uagccaaggaugacuugccua

SEQ ID NO: 3574 - RNA, 21 nt, Sorghum bicolor
uagccaaggaugacuugccug

SEQ ID NO: 3575 - RNA, 21 nt, Sorghum bicolor
uagccaaggaugacuugccug

SEQ ID NO: 3576 - RNA, 21 nt, Sorghum bicolor
uagccaaggaugacuugccug

SEQ ID NO: 3577 - RNA, 21 nt, Sorghum bicolor
uagccaaggaugacuugccug

SEQ ID NO: 3578 - RNA, 21 nt, Sorghum bicolor
uagccaagaaugacuugccua

SEQ ID NO: 3579 - RNA, 21 nt, Sorghum bicolor
ugauugagccgugccaauauc

SEQ ID NO: 3580 - RNA, 21 nt, Sorghum bicolor
ugauugagccgugccaauauc

SEQ ID NO: 3581 - RNA, 21 nt, Sorghum bicolor
gaggugagccgagccaauauc

SEQ ID NO: 3582 - RNA, 21 nt, Sorghum bicolor
ugauugagccgugccaauauc

SEQ ID NO: 3583 - RNA, 21 nt, Sorghum bicolor
gugagccgaaccaauaucacu

SEQ ID NO: 3584 - RNA, 21 nt, Sorghum bicolor
augagccgaaccaauaucacu

SEQ ID NO: 3585 - RNA, 20 nt, Sorghum bicolor
agaaucuugaugaugcugca

SEQ ID NO: 3586 - RNA, 20 nt, Sorghum bicolor
ggaaucuugaugaugcugca

SEQ ID NO: 3587 - RNA, 20 nt, Sorghum bicolor
agaaucuugaugaugcugca

SEQ ID NO: 3588 - RNA, 20 nt, Sorghum bicolor
agaaucuugaugaugcugca

SEQ ID NO: 3589 - RNA, 21 nt, Sorghum bicolor
ugaaucuugaugaugcugcac

SEQ ID NO: 3590 - RNA, 20 nt, Sorghum bicolor
uuggacugaagggugcuccc

SEQ ID NO: 3591 - RNA, 21 nt, Sorghum bicolor
uccaaagggaucgcauugauc

SEQ ID NO: 3592 - RNA, 20 nt, Sorghum bicolor
uuggcauucuguccaccucc

SEQ ID NO: 3593 - RNA, 20 nt, Sorghum bicolor
uuggcauucuguccaccucc

SEQ ID NO: 3594 - RNA, 21 nt, Sorghum bicolor
gugaaguguuugggggaacuc

SEQ ID NO: 3595 - RNA, 21 nt, Sorghum bicolor
gugaaguguuugggggaacuc

SEQ ID NO: 3596 - RNA, 21 nt, Sorghum bicolor
gugaaguguuugggggaacuc

SEQ ID NO: 3597 - RNA, 21 nt, Sorghum bicolor
gugaaguguuugggggaacuc

SEQ ID NO: 3598 - RNA, 21 nt, Sorghum bicolor
gugaaguguuugggggaacuc

SEQ ID NO: 3599 - RNA, 21 nt, Sorghum bicolor
augaaguguuugggggaacuc

SEQ ID NO: 3600 - RNA, 21 nt, Sorghum bicolor
uuccacagcuuucuugaacug

SEQ ID NO: 3601 - RNA, 21 nt, Sorghum bicolor
uuccacagcuuucuugaacug

SEQ ID NO: 3602 - RNA, 21 nt, Sorghum bicolor
uuccacagcuuucuugaacuu

SEQ ID NO: 3603 - RNA, 21 nt, Sorghum bicolor
ugccaaaggagaauugcccug

SEQ ID NO: 3604 - RNA, 21 nt, Sorghum bicolor
ugccaaaggagagcugcccug

SEQ ID NO: 3605 - RNA, 21 nt, Sorghum bicolor
ugccaaaggagaauugcccug

SEQ ID NO: 3606 - RNA, 21 nt, Sorghum bicolor
ugccaaaggagaguugcccug

SEQ ID NO: 3607 - RNA, 21 nt, Sorghum bicolor
ugccaaaggagauuugcccag

SEQ ID NO: 3608 - RNA, 21 nt, Sorghum bicolor
ugccaaaggagauuugcccag

SEQ ID NO: 3609 - RNA, 21 nt, Sorghum bicolor
ugccaaaggaaauuugccccg

SEQ ID NO: 3610 - RNA, 21 nt, Sorghum bicolor
ugccaaaggagaauugcccug

SEQ ID NO: 3611 - RNA, 21 nt, Sorghum bicolor
ugccaaaggagaguugcccug

SEQ ID NO: 3612 - RNA, 22 nt, Saguinus labiatus
aacccguagauccgaacuugug

SEQ ID NO: 3613 - RNA, 22 nt, Saguinus labiatus
uacaguacugugauaacugaag

SEQ ID NO: 3614 - RNA, 20 nt, Saguinus labiatus
ucaaaugcucagacuccugu

SEQ ID NO: 3615 - RNA, 24 nt, Saguinus labiatus
aaaagugcuuacagugcagguagc

SEQ ID NO: 3616 - RNA, 21 nt, Saguinus labiatus
uaaagugcugacagugcagau

SEQ ID NO: 3617 - RNA, 23 nt, Saguinus labiatus
uacccuguagauccgaauuugug

SEQ ID NO: 3618 - RNA, 22 nt, Saguinus labiatus
ucccugagacccuaacuuguga

SEQ ID NO: 3619 - RNA, 22 nt, Saguinus labiatus
ucggauccgucugagcuuggcu

SEQ ID NO: 3620 - RNA, 22 nt, Saguinus labiatus
ucacagugaaccggucucuuuu

SEQ ID NO: 3621 - RNA, 22 nt, Saguinus labiatus
uugguccccuucaaccagcugu

SEQ ID NO: 3622 - RNA, 20 nt, Saguinus labiatus
guguguggaaaugcuucugc

SEQ ID NO: 3623 - RNA, 22 nt, Saguinus labiatus
uagcagcacauaaugguuugug

SEQ ID NO: 3624 - RNA, 22 nt, Saguinus labiatus
uagcagcacguaaauauuggcg

SEQ ID NO: 3625 - RNA, 20 nt, Saguinus labiatus
acugcagugaaggcacuugu

SEQ ID NO: 3626 - RNA, 24 nt, Saguinus labiatus
caaagugcuuacagugcagguagu

SEQ ID NO: 3627 - RNA, 22 nt, Saguinus labiatus
uaaggugcaucuagugcagaua

SEQ ID NO: 3628 - RNA, 23 nt, Saguinus labiatus
aacauucaacgcugucggugagu

SEQ ID NO: 3629 - RNA, 23 nt, Saguinus labiatus
uauggcacugguagaauucacug

SEQ ID NO: 3630 - RNA, 19 nt, Saguinus labiatus
gguccagaggggagcucga

SEQ ID NO: 3631 - RNA, 23 nt, Saguinus labiatus
cccaguguucagacuaccuguuc

SEQ ID NO: 3632 - RNA, 23 nt, Saguinus labiatus
ugugcaaaucuaugcaaaacuga

SEQ ID NO: 3633 - RNA, 23 nt, Saguinus labiatus
ugugcaaauccaugcaaaacuga

SEQ ID NO: 3634 - RNA, 22 nt, Saguinus labiatus
uaaagugcuuauagugcaggua

SEQ ID NO: 3635 - RNA, 22 nt, Saguinus labiatus
uucccuuugucauccuaugccu

SEQ ID NO: 3636 - RNA, 21 nt, Saguinus labiatus
acagcaggcacagacaggcag

SEQ ID NO: 3637 - RNA, 21 nt, Saguinus labiatus
uugugcuugaucuaaccaugu

SEQ ID NO: 3638 - RNA, 22 nt, Saguinus labiatus
aagcugccaguugaagaacugu

SEQ ID NO: 3639 - RNA, 21 nt, Saguinus labiatus
ugucaguuugucaaauacccc

SEQ ID NO: 3640 - RNA, 21 nt, Saguinus labiatus
aucacauugccagggauuucc

SEQ ID NO: 3641 - RNA, 22 nt, Saguinus labiatus
uucacaguggcuaaguuccgcc

SEQ ID NO: 3642 - RNA, 22 nt, Saguinus labiatus
aaggagcucacagucuauugag

SEQ ID NO: 3643 - RNA, 22 nt, Saguinus labiatus
cuagcaccaucugaaaucgguu

SEQ ID NO: 3644 - RNA, 20 nt, Saguinus labiatus
uagcaccauuugaaaucagu

SEQ ID NO: 3645 - RNA, 21 nt, Saguinus labiatus
uauugcacauuacuaaguugc

SEQ ID NO: 3646 - RNA, 22 nt, Saguinus labiatus
uggcagugucuuagcugguugu

SEQ ID NO: 3647 - RNA, 21 nt, Saguinus labiatus
uggaagacuagugauuuuguu

SEQ ID NO: 3648 - RNA, 22 nt, Saguinus labiatus
uauugcacuugucccggccugu

SEQ ID NO: 3649 - RNA, 22 nt, Saguinus labiatus
aaagugcuguucgugcagguag

SEQ ID NO: 3650 - RNA, 22 nt, Saguinus labiatus
uucaacggguauuuauugagca

SEQ ID NO: 3651 - RNA, 22 nt, Saguinus labiatus
uuuggcacuagcacauuuuugc

SEQ ID NO: 3652 - RNA, 21 nt, Schmidtea mediterranea
ugagaucacuaugaaagcugg

SEQ ID NO: 3653 - RNA, 22 nt, Schmidtea mediterranea
ugagaucacugcgaaagcugau

SEQ ID NO: 3654 - RNA, 22 nt, Schmidtea mediterranea
ugagaucauuaugaaagcuuuu

SEQ ID NO: 3655 - RNA, 22 nt, Schmidtea mediterranea
ugagguagaauguuggaugacu

SEQ ID NO: 3656 - RNA, 22 nt, Schmidtea mediterranea
ugagguagauuguuggaugacu

SEQ ID NO: 3657 - RNA, 22 nt, Schmidtea mediterranea
ccauucaacuaucugucuucuc

SEQ ID NO: 3658 - RNA, 22 nt, Schmidtea mediterranea
ugagguagugacucaaaagguu

SEQ ID NO: 3659 - RNA, 22 nt, Schmidtea mediterranea
ucccugagaccuucgacugugu

SEQ ID NO: 3660 - RNA, 22 nt, Schmidtea mediterranea
aacccuguagauccgaguuuga

SEQ ID NO: 3661 - RNA, 18 nt, Schmidtea mediterranea
ucgaaucuucaaggugaa

SEQ ID NO: 3662 - RNA, 22 nt, Schmidtea mediterranea
ugaguauucuaucaggagucga

SEQ ID NO: 3663 - RNA, 21 nt, Schmidtea mediterranea
uaaggcacgcggugaaugcuu

SEQ ID NO: 3664 - RNA, 22 nt, Schmidtea mediterranea
uaaggcacgcggugaaugcuga

SEQ ID NO: 3665 - RNA, 21 nt, Schmidtea mediterranea
uaaggcacgcggugaaugcca

SEQ ID NO: 3666 - RNA, 22 nt, Schmidtea mediterranea
gcgcucaccucgugaccuuugu

SEQ ID NO: 3667 - RNA, 22 nt, Schmidtea mediterranea
ucccugagaccauugacugcau

SEQ ID NO: 3668 - RNA, 20 nt, Schmidtea mediterranea
guaguuuuugguaucaggau

SEQ ID NO: 3669 - RNA, 22 nt, Schmidtea mediterranea
ucccugagaucauaauaugccu

SEQ ID NO: 3670 - RNA, 22 nt, Schmidtea mediterranea
uaucacagucaugcuaaagagc

SEQ ID NO: 3671 - RNA, 20 nt, Schmidtea mediterranea
uugguccccaucaaccagca

SEQ ID NO: 3672 - RNA, 20 nt, Schmidtea mediterranea
gacggagguuugcuaaggaa

SEQ ID NO: 3673 - RNA, 23 nt, Schmidtea mediterranea
agauauguuugguuaauugguga

SEQ ID NO: 3674 - RNA, 21 nt, Schmidtea mediterranea
accacugaccgagcauaucca

SEQ ID NO: 3675 - RNA, 23 nt, Schmidtea mediterranea
ugauauguuugguuuauugguga

SEQ ID NO: 3676 - RNA, 23 nt, Schmidtea mediterranea
accauuagccuaauguaucgugu

SEQ ID NO: 3677 - RNA, 22 nt, Schmidtea mediterranea
uggaaugucgagaaauaugcau

SEQ ID NO: 3678 - RNA, 22 nt, Schmidtea mediterranea
uggaaugucgugaauuaugguc

SEQ ID NO: 3679 - RNA, 21 nt, Schmidtea mediterranea
uggaauguugugaauaguguc

SEQ ID NO: 3680 - RNA, 23 nt, Schmidtea mediterranea
ugauuguccauacgcaguucuca

SEQ ID NO: 3681 - RNA, 22 nt, Schmidtea mediterranea
uaaaugcacuaucggauaugac

SEQ ID NO: 3682 - RNA, 22 nt, Schmidtea mediterranea
aaaaugcauuaucuggccaaga

SEQ ID NO: 3683 - RNA, 20 nt, Schmidtea mediterranea
uugaucagaaaugcagcuuc

SEQ ID NO: 3684 - RNA, 22 nt, Schmidtea mediterranea
uaaaugcauuaucugguaugau

SEQ ID NO: 3685 - RNA, 22 nt, Schmidtea mediterranea
uaaaugcauuuaucuggccaag

SEQ ID NO: 3686 - RNA, 20 nt, Schmidtea mediterranea
ucggugggaguaacauucga

SEQ ID NO: 3687 - RNA, 19 nt, Schmidtea mediterranea
ugucauggauaugcucuuc

SEQ ID NO: 3688 - RNA, 20 nt, Schmidtea mediterranea
ugaagagcuauucaugaggu

SEQ ID NO: 3689 - RNA, 24 nt, Schmidtea mediterranea
uaucacagccccgcuuggaacgcu

SEQ ID NO: 3690 - RNA, 20 nt, Schmidtea mediterranea
guucuacgguguugugauau

SEQ ID NO: 3691 - RNA, 22 nt, Schmidtea mediterranea
ucacagccaauuuugaugagau

SEQ ID NO: 3692 - RNA, 20 nt, Schmidtea mediterranea
ucaucauuguugguugucag

SEQ ID NO: 3693 - RNA, 22 nt, Schmidtea mediterranea
ucacagccaaaacugaugaucu

SEQ ID NO: 3694 - RNA, 21 nt, Schmidtea mediterranea
ucacagccaaauuugaugucc

SEQ ID NO: 3695 - RNA, 23 nt, Schmidtea mediterranea
aggcaagauguuggcauaacuga

SEQ ID NO: 3696 - RNA, 23 nt, Schmidtea mediterranea
aggcaagaugcuggcauagcuga

SEQ ID NO: 3697 - RNA, 21 nt, Schmidtea mediterranea
ucaccggguagacauucauua

SEQ ID NO: 3698 - RNA, 20 nt, Schmidtea mediterranea
ugaugcaugcuacuugguuu

SEQ ID NO: 3699 - RNA, 23 nt, Schmidtea mediterranea
ugacuagaaaguucacuuacugu

SEQ ID NO: 3700 - RNA, 23 nt, Schmidtea mediterranea
ucacaaccuccaugaacgagggu

SEQ ID NO: 3701 - RNA, 22 nt, Schmidtea mediterranea
ugaaagacacggguagugagau

SEQ ID NO: 3702 - RNA, 22 nt, Schmidtea mediterranea
ugaaagacacagguagugggac

SEQ ID NO: 3703 - RNA, 20 nt, Schmidtea mediterranea
uccuucuaauguguuuuucg

SEQ ID NO: 3704 - RNA, 22 nt, Schmidtea mediterranea
ugaaagacauggguagugagau

SEQ ID NO: 3705 - RNA, 23 nt, Schmidtea mediterranea
ugcugccugguuaagagcugugu

SEQ ID NO: 3706 - RNA, 22 nt, Schmidtea mediterranea
uagcaccaggguauaucgggau

SEQ ID NO: 3707 - RNA, 23 nt, Schmidtea mediterranea
uaaucucaucugguaauugaagu

SEQ ID NO: 3708 - RNA, 19 nt, Schmidtea mediterranea
uggacggaaguguaaugag

SEQ ID NO: 3709 - RNA, 21 nt, Schmidtea mediterranea
gcugggaugagccucgguggu

SEQ ID NO: 3710 - RNA, 23 nt, Schmidtea mediterranea
ucagaucuaacucuuccaguucu

SEQ ID NO: 3711 - RNA, 21 nt, Schmidtea mediterranea
cauguuugaauggccaugaca

SEQ ID NO: 3712 - RNA, 18 nt, Schmidtea mediterranea
agucagcauuggugguuu

SEQ ID NO: 3713 - RNA, 20 nt, Schmidtea mediterranea
gagcuuggauugugaucuca

SEQ ID NO: 3714 - RNA, 20 nt, Schmidtea mediterranea
guugcuugggguuauuacua

SEQ ID NO: 3715 - RNA, 20 nt, Schmidtea mediterranea
uggagcuauuguauuucacc

SEQ ID NO: 3716 - RNA, 22 nt, Schmidtea mediterranea
cgauaugugguaauuuggauga

SEQ ID NO: 3717 - RNA, 23 nt, Schmidtea mediterranea
guaaagcuaaauuaccaaagugc

SEQ ID NO: 3718 - RNA, 23 nt, Schmidtea mediterranea
uggaagacuauugauuuaguuga

SEQ ID NO: 3719 - RNA, 23 nt, Schmidtea mediterranea
uggaagacugucgauuucguugu

SEQ ID NO: 3720 - RNA, 22 nt, Schmidtea mediterranea
uggaagacugaugauuugcuga

SEQ ID NO: 3721 - RNA, 23 nt, Schmidtea mediterranea
uaauacugucagguaacgaugcc

SEQ ID NO: 3722 - RNA, 20 nt, Schmidtea mediterranea
ugagcaaaguuucaagugua

SEQ ID NO: 3723 - RNA, 21 nt, Schmidtea mediterranea
gugagcaaagcuucaaaugag

SEQ ID NO: 3724 - RNA, 20 nt, Schmidtea mediterranea
gauugcacuaguuaauuauc

SEQ ID NO: 3725 - RNA, 20 nt, Saccharum officinarum
ugacagaagagagugagcac

SEQ ID NO: 3726 - RNA, 21 nt, Saccharum officinarum
uuuggauugaagggagcucug

SEQ ID NO: 3727 - RNA, 21 nt, Saccharum officinarum
uuuggauugaagggagcucug

SEQ ID NO: 3728 - RNA, 21 nt, Saccharum officinarum
cuuggauugaagggagcuccu

SEQ ID NO: 3729 - RNA, 21 nt, Saccharum officinarum
uuuggauugaagggagcucug

SEQ ID NO: 3730 - RNA, 21 nt, Saccharum officinarum
uuuggauugaaaggagcucuu

SEQ ID NO: 3731 - RNA, 21 nt, Saccharum officinarum
ugaagcugccagcaugaucug

SEQ ID NO: 3732 - RNA, 21 nt, Saccharum officinarum
ugaagcugccagcaugaucug

SEQ ID NO: 3733 - RNA, 21 nt, Saccharum officinarum
ucgcuuggugcagaucgggac

SEQ ID NO: 3734 - RNA, 20 nt, Saccharum officinarum
ucgcuugggcagaucgggac

SEQ ID NO: 3735 - RNA, 21 nt, Saccharum officinarum
uuccacagcuuucuugaacug

SEQ ID NO: 3736 - RNA, 21 nt, Saccharum officinarum
cugcacugccucuucccuggc

SEQ ID NO: 3737 - RNA, 21 nt, Saccharum officinarum
cugcacugccucuucccuggc

SEQ ID NO: 3738 - RNA, 21 nt, Saccharum officinarum
cugcacugccucuucccuggc

SEQ ID NO: 3739 - RNA, 21 nt, Saccharum officinarum
cugcacugccucuucccuggc

SEQ ID NO: 3740 - RNA, 21 nt, Saccharum officinarum
cugcacugacucuucccuggc

SEQ ID NO: 3741 - RNA, 22 nt, Sus scrofa
ugagguaguagguuguaugguu

SEQ ID NO: 3742 - RNA, 22 nt, Sus scrofa
ugagguaguagauuguauaguu

SEQ ID NO: 3743 - RNA, 19 nt, Sus scrofa
ugagguaguaguuugugcu

SEQ ID NO: 3744 - RNA, 23 nt, Sus scrofa
agcagcauuguacagggcuauga

SEQ ID NO: 3745 - RNA, 20 nt, Sus scrofa
ucaaaugcucagacuccugu

SEQ ID NO: 3746 - RNA, 20 nt, Sus scrofa
ucaaaugcucagacuccuug

SEQ ID NO: 3747 - RNA, 24 nt, Sus scrofa
aaaagugcuuacagugcagguagc

SEQ ID NO: 3748 - RNA, 23 nt, Sus scrofa
agcagcauuguacagggcuauca

SEQ ID NO: 3749 - RNA, 23 nt, Sus scrofa
uggagugugacaaugguguuugu

SEQ ID NO: 3750 - RNA, 22 nt, Sus scrofa
uuaaggcacgcggugaaugcca

SEQ ID NO: 3751 - RNA, 22 nt, Sus scrofa
ucccugagacccuaacuuguga

SEQ ID NO: 3752 - RNA, 22 nt, Sus scrofa
ucacagugaaccggucucuuuu

SEQ ID NO: 3753 - RNA, 23 nt, Sus scrofa
uauggcuuuuuauuccuauguga

SEQ ID NO: 3754 - RNA, 23 nt, Sus scrofa
acuccauuuguuuugaugaugga

SEQ ID NO: 3755 - RNA, 18 nt, Sus scrofa
ucuacagugcacgugucu

SEQ ID NO: 3756 - RNA, 21 nt, Sus scrofa
agugguuuuacccuaugguag

SEQ ID NO: 3757 - RNA, 24 nt, Sus scrofa
guccaguuuucccaggaaucccuu

SEQ ID NO: 3758 - RNA, 22 nt, Sus scrofa
ucagugcacuacagaacuuugu

SEQ ID NO: 3759 - RNA, 20 nt, Sus scrofa
uugcauagucacaaaaguga

SEQ ID NO: 3760 - RNA, 22 nt, Sus scrofa
ccgcagcacaucaugguuuaca

SEQ ID NO: 3761 - RNA, 22 nt, Sus scrofa
uaaggugcaucuagugcagaua

SEQ ID NO: 3762 - RNA, 24 nt, Sus scrofa
aacauucauugcugucgguggguu

SEQ ID NO: 3763 - RNA, 22 nt, Sus scrofa
aacauucaaccugucggugagu

SEQ ID NO: 3764 - RNA, 23 nt, Sus scrofa
uauggcacugguagaauucacug

SEQ ID NO: 3765 - RNA, 22 nt, Sus scrofa
uggacggagaacugauaagggu

SEQ ID NO: 3766 - RNA, 23 nt, Sus scrofa
caaagaauucuccuuuugggcuu

SEQ ID NO: 3767 - RNA, 21 nt, Sus scrofa
uagguaguuucauguuguugg

SEQ ID NO: 3768 - RNA, 23 nt, Sus scrofa
ugugcaaaucuaugcaaaacuga

SEQ ID NO: 3769 - RNA, 22 nt, Sus scrofa
uaaagugcuuauagugcaggua

SEQ ID NO: 3770 - RNA, 22 nt, Sus scrofa
uucccuuugucauccuaugccu

SEQ ID NO: 3771 - RNA, 22 nt, Sus scrofa
uccuucauuccaccggagucug

SEQ ID NO: 3772 - RNA, 22 nt, Sus scrofa
uagcuuaucagacugauguuga

SEQ ID NO: 3773 - RNA, 21 nt, Sus scrofa
acagcaggcacagacaggcag

SEQ ID NO: 3774 - RNA, 21 nt, Sus scrofa
uaaucucagcuggcaacugug

SEQ ID NO: 3775 - RNA, 24 nt, Sus scrofa
uacugcaucaggaacugauuggau

SEQ ID NO: 3776 - RNA, 23 nt, Sus scrofa
caagucacuagugguuccguuua

SEQ ID NO: 3777 - RNA, 21 nt, Sus scrofa
aucacauugccagggauuucc

SEQ ID NO: 3778 - RNA, 22 nt, Sus scrofa
uggcucaguucagcaggaacag

SEQ ID NO: 3779 - RNA, 22 nt, Sus scrofa
uucaaguaauccaggauaggcu

SEQ ID NO: 3780 - RNA, 21 nt, Sus scrofa
uucacaguggcuaaguuccgc

SEQ ID NO: 3781 - RNA, 22 nt, Sus scrofa
aaggagcucacacucuauugag

SEQ ID NO: 3782 - RNA, 20 nt, Sus scrofa
uagcaccauuugaaaucagu

SEQ ID NO: 3783 - RNA, 22 nt, Sus scrofa
uagcaccauuugaaaucgguua

SEQ ID NO: 3784 - RNA, 23 nt, Sus scrofa
caguccaauaguauugucaaagc

SEQ ID NO: 3785 - RNA, 23 nt, Sus scrofa
uguaaacauccuacacucucagc

SEQ ID NO: 3786 - RNA, 21 nt, Sus scrofa
uauugcacauuacuaaguugc

SEQ ID NO: 3787 - RNA, 22 nt, Sus scrofa
gcacauuacacggucgaccucu

SEQ ID NO: 3788 - RNA, 23 nt, Sus scrofa
ccuaguagguguucaguaagugu

SEQ ID NO: 3789 - RNA, 20 nt, Sus scrofa
ccucugggcccuuccuccag

SEQ ID NO: 3790 - RNA, 21 nt, Sus scrofa
uggaagacuagugauuuuguu

SEQ ID NO: 3791 - RNA, 23 nt, Sus scrofa
ucuuugguuaucuagcuguauga

SEQ ID NO: 3792 - RNA, 23 nt, Sus scrofa
ucuuugguuaucuagcuguauga

SEQ ID NO: 3793 - RNA, 22 nt, Sus scrofa
uucaacggguauuuauugagca

SEQ ID NO: 3794 - RNA, 20 nt, Simian virus 40
gccuguuucaugcccugagu

SEQ ID NO: 3795 - RNA, 22 nt, Simian virus 40
ugaggggccugaaaugagccuu

SEQ ID NO: 3796 - RNA, 22 nt, Tetraodon nigroviridis
ugagguaguagguuguauaguu

SEQ ID NO: 3797 - RNA, 22 nt, Tetraodon nigroviridis
ugagguaguagguugugugguu

SEQ ID NO: 3798 - RNA, 22 nt, Tetraodon nigroviridis
ugagguaguugguuguaugguu

SEQ ID NO: 3799 - RNA, 22 nt, Tetraodon nigroviridis
ugagguaguagauugaauaguu

SEQ ID NO: 3800 - RNA, 22 nt, Tetraodon nigroviridis
ugagguaguaguuuguauaguu

SEQ ID NO: 3801 - RNA, 22 nt, Tetraodon nigroviridis
ugagguaguaaguuguguuguu

SEQ ID NO: 3802 - RNA, 22 nt, Tetraodon nigroviridis
ugagguaguaguuugugcuguu

SEQ ID NO: 3803 - RNA, 22 nt, Tetraodon nigroviridis
ugagguaguuuuuuguacaguu

SEQ ID NO: 3804 - RNA, 22 nt, Tetraodon nigroviridis
uggaauguaaagaaguauguau

SEQ ID NO: 3805 - RNA, 22 nt, Tetraodon nigroviridis
aacccguagauccgaacuugug

SEQ ID NO: 3806 - RNA, 22 nt, Tetraodon nigroviridis
uacaguacugugauaacugaag

SEQ ID NO: 3807 - RNA, 22 nt, Tetraodon nigroviridis
uacaguacuaugauaacugaag

SEQ ID NO: 3808 - RNA, 23 nt, Tetraodon nigroviridis
agcagcauuguacagggcuauga

SEQ ID NO: 3809 - RNA, 23 nt, Tetraodon nigroviridis
agcagcauuguacagggcuauca

SEQ ID NO: 3810 - RNA, 23 nt, Tetraodon nigroviridis
uacccuguagaaccgaauuugug

SEQ ID NO: 3811 - RNA, 22 nt, Tetraodon nigroviridis
uacccuguagauccggauuugu

SEQ ID NO: 3812 - RNA, 25 nt, Tetraodon nigroviridis
uacccuguagaaccgaaugugugug

SEQ ID NO: 3813 - RNA, 22 nt, Tetraodon nigroviridis
uggagugugacaaugguguuug

SEQ ID NO: 3814 - RNA, 22 nt, Tetraodon nigroviridis
uaaggcacgcggugaaugccaa

SEQ ID NO: 3815 - RNA, 22 nt, Tetraodon nigroviridis
ucccugagacccuuaaccugug

SEQ ID NO: 3816 - RNA, 22 nt, Tetraodon nigroviridis
ucccugagacccuaacuuguga

SEQ ID NO: 3817 - RNA, 21 nt, Tetraodon nigroviridis
ucguaccgugaguaauaaugc

SEQ ID NO: 3818 - RNA, 22 nt, Tetraodon nigroviridis
ucacagugaaccggucucuuuu

SEQ ID NO: 3819 - RNA, 22 nt, Tetraodon nigroviridis
cuuuuugcggucugggcuugcu

SEQ ID NO: 3820 - RNA, 22 nt, Tetraodon nigroviridis
cagugcaauauuaaaagggcau

SEQ ID NO: 3821 - RNA, 22 nt, Tetraodon nigroviridis
uaacagucuacagccauggucg

SEQ ID NO: 3822 - RNA, 22 nt, Tetraodon nigroviridis
uuugguccccuucaaccagcug

SEQ ID NO: 3823 - RNA, 22 nt, Tetraodon nigroviridis
uauggcuuucuauuccuaugug

SEQ ID NO: 3824 - RNA, 22 nt, Tetraodon nigroviridis
uauggcuuuuuauuccuaucug

SEQ ID NO: 3825 - RNA, 22 nt, Tetraodon nigroviridis
uuauugcuugagaauacgcgua

SEQ ID NO: 3826 - RNA, 22 nt, Tetraodon nigroviridis
agcugguguugugaaucaggcc

SEQ ID NO: 3827 - RNA, 22 nt, Tetraodon nigroviridis
cagugguuuuacccuaugguag

SEQ ID NO: 3828 - RNA, 21 nt, Tetraodon nigroviridis
cauaaaguagaaagcacuacu

SEQ ID NO: 3829 - RNA, 22 nt, Tetraodon nigroviridis
cauaaaguagaaagcacuacua

SEQ ID NO: 3830 - RNA, 20 nt, Tetraodon nigroviridis
uacaguauagaugauguacu

SEQ ID NO: 3831 - RNA, 22 nt, Tetraodon nigroviridis
ucagugcauuacagaacuuugu

SEQ ID NO: 3832 - RNA, 22 nt, Tetraodon nigroviridis
ucagugcauaacagaacuuugu

SEQ ID NO: 3833 - RNA, 22 nt, Tetraodon nigroviridis
uugcauagucacaaaagugauc

SEQ ID NO: 3834 - RNA, 22 nt, Tetraodon nigroviridis
uugcauagucacaaaaaugagc

SEQ ID NO: 3835 - RNA, 22 nt, Tetraodon nigroviridis
uagcagcacggaaugguuugug

SEQ ID NO: 3836 - RNA, 22 nt, Tetraodon nigroviridis
uagcagcgcaucaugguuugua

SEQ ID NO: 3837 - RNA, 22 nt, Tetraodon nigroviridis
uagcagcacguaaauauuggag

SEQ ID NO: 3838 - RNA, 22 nt, Tetraodon nigroviridis
caaagugcuuacagugcaggua

SEQ ID NO: 3839 - RNA, 22 nt, Tetraodon nigroviridis
uaaggugcaucuagugcagaua

SEQ ID NO: 3840 - RNA, 23 nt, Tetraodon nigroviridis
aacauucaacgcugucggugagu

SEQ ID NO: 3841 - RNA, 22 nt, Tetraodon nigroviridis
accaucgaccguugauuguacc

SEQ ID NO: 3842 - RNA, 22 nt, Tetraodon nigroviridis
aacauucauugcugucgguggg

SEQ ID NO: 3843 - RNA, 21 nt, Tetraodon nigroviridis
ugguucuagacuugccaacua

SEQ ID NO: 3844 - RNA, 23 nt, Tetraodon nigroviridis
uauggcacugguagaauucacug

SEQ ID NO: 3845 - RNA, 21 nt, Tetraodon nigroviridis
uggacggagaacugauaaggg

SEQ ID NO: 3846 - RNA, 20 nt, Tetraodon nigroviridis
ucgugucuuguguugcagcc

SEQ ID NO: 3847 - RNA, 22 nt, Tetraodon nigroviridis
ugauauguuugauauauuaggu

SEQ ID NO: 3848 - RNA, 21 nt, Tetraodon nigroviridis
augaccuaugaauugacagcc

SEQ ID NO: 3849 - RNA, 22 nt, Tetraodon nigroviridis
aacuggccuacaaagucccagu

SEQ ID NO: 3850 - RNA, 21 nt, Tetraodon nigroviridis
uguaacagcaacuccaugugg

SEQ ID NO: 3851 - RNA, 22 nt, Tetraodon nigroviridis
uagguaguuucauguuguuggg

SEQ ID NO: 3852 - RNA, 22 nt, Tetraodon nigroviridis
uagguaguuucaaguuguuggg

SEQ ID NO: 3853 - RNA, 23 nt, Tetraodon nigroviridis
cccaguguucagacuaccuguuc

SEQ ID NO: 3854 - RNA, 23 nt, Tetraodon nigroviridis
ugugcaaaucuaugcaaaacuga

SEQ ID NO: 3855 - RNA, 23 nt, Tetraodon nigroviridis
ugugcaaauccaugcaaaacuga

SEQ ID NO: 3856 - RNA, 23 nt, Tetraodon nigroviridis
uaaagugcuuauagugcagguag

SEQ ID NO: 3857 - RNA, 22 nt, Tetraodon nigroviridis
uaacacugucugguaacgaugu

SEQ ID NO: 3858 - RNA, 22 nt, Tetraodon nigroviridis
uaauacugccugguaaugauga

SEQ ID NO: 3859 - RNA, 22 nt, Tetraodon nigroviridis
agaggcauagggcaugggaaaa

SEQ ID NO: 3860 - RNA, 22 nt, Tetraodon nigroviridis
gugaaauguuuaggaccacuug

SEQ ID NO: 3861 - RNA, 22 nt, Tetraodon nigroviridis
uucccuuugucauccuaugccu

SEQ ID NO: 3862 - RNA, 22 nt, Tetraodon nigroviridis
uucccuuuguuauccuaugccu

SEQ ID NO: 3863 - RNA, 22 nt, Tetraodon nigroviridis
uccuucauuccaccggagucug

SEQ ID NO: 3864 - RNA, 23 nt, Tetraodon nigroviridis
uagcuuaucagacugguguuggc

SEQ ID NO: 3865 - RNA, 22 nt, Tetraodon nigroviridis
cugugcgugugacagcggcuaa

SEQ ID NO: 3866 - RNA, 21 nt, Tetraodon nigroviridis
uaacagucuacagucauggcu

SEQ ID NO: 3867 - RNA, 21 nt, Tetraodon nigroviridis
acagcaggcacagacaggcag

SEQ ID NO: 3868 - RNA, 22 nt, Tetraodon nigroviridis
aaaucucagcuggcaacuguga

SEQ ID NO: 3869 - RNA, 22 nt, Tetraodon nigroviridis
uaaucucugcaggcaacuguga

SEQ ID NO: 3870 - RNA, 22 nt, Tetraodon nigroviridis
uacugcaucaggaacugauugg

SEQ ID NO: 3871 - RNA, 22 nt, Tetraodon nigroviridis
uugugcuugaucuaaccaugug

SEQ ID NO: 3872 - RNA, 22 nt, Tetraodon nigroviridis
uugugcuugaucuaaccaugca

SEQ ID NO: 3873 - RNA, 22 nt, Tetraodon nigroviridis
ugauuguccaaacgcaauucuu

SEQ ID NO: 3874 - RNA, 23 nt, Tetraodon nigroviridis
agcuacauugucugcuggguuuc

SEQ ID NO: 3875 - RNA, 24 nt, Tetraodon nigroviridis
agcuacaucuggcuacugggucuc

SEQ ID NO: 3876 - RNA, 21 nt, Tetraodon nigroviridis
ugucaguuugucaaauacccc

SEQ ID NO: 3877 - RNA, 22 nt, Tetraodon nigroviridis
aagcugccagcugaagaacugu

SEQ ID NO: 3878 - RNA, 22 nt, Tetraodon nigroviridis
aagcugccaguugaagagcugu

SEQ ID NO: 3879 - RNA, 22 nt, Tetraodon nigroviridis
aucacauugccagggauuucca

SEQ ID NO: 3880 - RNA, 22 nt, Tetraodon nigroviridis
aucacauugccagggauuacca

SEQ ID NO: 3881 - RNA, 22 nt, Tetraodon nigroviridis
uggcucaguucagcaggaacag

SEQ ID NO: 3882 - RNA, 22 nt, Tetraodon nigroviridis
cauugcacuugucucggucuga

SEQ ID NO: 3883 - RNA, 22 nt, Tetraodon nigroviridis
uucaaguaauccaggauaggcu

SEQ ID NO: 3884 - RNA, 22 nt, Tetraodon nigroviridis
uucacaguggcuaaguucugca

SEQ ID NO: 3885 - RNA, 21 nt, Tetraodon nigroviridis
uucacagugguuaaguucugc

SEQ ID NO: 3886 - RNA, 22 nt, Tetraodon nigroviridis
uucacaguggcuaaguucagug

SEQ ID NO: 3887 - RNA, 22 nt, Tetraodon nigroviridis
uagcaccauuugaaaucgguua

SEQ ID NO: 3888 - RNA, 22 nt, Tetraodon nigroviridis
uagcaccauuugaaaucagugu

SEQ ID NO: 3889 - RNA, 22 nt, Tetraodon nigroviridis
cagugcaauaguauugucauag

SEQ ID NO: 3890 - RNA, 22 nt, Tetraodon nigroviridis
uguaaacauccuacacucagcu

SEQ ID NO: 3891 - RNA, 22 nt, Tetraodon nigroviridis
uguaaacauccuacacucucgg

SEQ ID NO: 3892 - RNA, 22 nt, Tetraodon nigroviridis
uguaaacauccccgacuggaag

SEQ ID NO: 3893 - RNA, 22 nt, Tetraodon nigroviridis
uccagcaucagugauuuuguug

SEQ ID NO: 3894 - RNA, 22 nt, Tetraodon nigroviridis
uaaugccccuaaaaauccuuau

SEQ ID NO: 3895 - RNA, 22 nt, Tetraodon nigroviridis
uuuguucguucggcucgcguua

SEQ ID NO: 3896 - RNA, 22 nt, Tetraodon nigroviridis
uaauacugucugguaaugccgu

SEQ ID NO: 3897 - RNA, 22 nt, Tetraodon nigroviridis
uaugugcccuuggacuacaucg

SEQ ID NO: 3898 - RNA, 22 nt, Tetraodon nigroviridis
auagcucuuuaaaugguucugc

SEQ ID NO: 3899 - RNA, 22 nt, Tetraodon nigroviridis
cacagcgcauacaauguggaug

SEQ ID NO: 3900 - RNA, 23 nt, Tetraodon nigroviridis
agugacaucauauguacggcugc

SEQ ID NO: 3901 - RNA, 23 nt, Tetraodon nigroviridis
uggaagacuagugauuuuguugu

SEQ ID NO: 3902 - RNA, 23 nt, Tetraodon nigroviridis
ucuuugguuaucuagcuguauga

SEQ ID NO: 3903 - RNA, 22 nt, Tetraodon nigroviridis
uauugcacuugucccggccugu

SEQ ID NO: 3904 - RNA, 23 nt, Tetraodon nigroviridis
uuuggcacuagcacauuuuugcu

SEQ ID NO: 3905 - RNA, 22 nt, Xenopus laevis
uugguccccuucaaccagcugu

SEQ ID NO: 3906 - RNA, 23 nt, Xenopus laevis
uaaggugcaucuagugcaguuag

SEQ ID NO: 3907 - RNA, 23 nt, Xenopus laevis
ugugcaaauccaugcaaaacuga

SEQ ID NO: 3908 - RNA, 23 nt, Xenopus laevis
caaagugcucauagugcagguag

SEQ ID NO: 3909 - RNA, 22 nt, Xenopus laevis
aaagugcuuucuguuuugggcg

SEQ ID NO: 3910 - RNA, 22 nt, Xenopus laevis
uaagugcucucuaguucgguug

SEQ ID NO: 3911 - RNA, 21 nt, Xenopus laevis
uaauacugucugguaaugccg

SEQ ID NO: 3912 - RNA, 22 nt, Xenopus tropicalis
ugagguaguagguuguauaguu

SEQ ID NO: 3913 - RNA, 22 nt, Xenopus tropicalis
ugagguaguaguuuguguaguu

SEQ ID NO: 3914 - RNA, 22 nt, Xenopus tropicalis
ugagguaguagguuguaugguu

SEQ ID NO: 3915 - RNA, 22 nt, Xenopus tropicalis
ugagguaguagguuguuuaguu

SEQ ID NO: 3916 - RNA, 21 nt, Xenopus tropicalis
ugagguaguagauuguauagu

SEQ ID NO: 3917 - RNA, 21 nt, Xenopus tropicalis
ugagguaguuguuuguacagu

SEQ ID NO: 3918 - RNA, 21 nt, Xenopus tropicalis
ugagguaguaguuugugcugu

SEQ ID NO: 3919 - RNA, 22 nt, Xenopus tropicalis
aacccguagauccgaacuugug

SEQ ID NO: 3920 - RNA, 22 nt, Xenopus tropicalis
uacaguacugugauaacugaag

SEQ ID NO: 3921 - RNA, 23 nt, Xenopus tropicalis
agcagcauuguacagggcuauga

SEQ ID NO: 3922 - RNA, 24 nt, Xenopus tropicalis
aaaagugcuuauagugcagguaga

SEQ ID NO: 3923 - RNA, 23 nt, Xenopus tropicalis
agcagcauuguacagggcuauca

SEQ ID NO: 3924 - RNA, 23 nt, Xenopus tropicalis
uacccuguagauccgaauuugug

SEQ ID NO: 3925 - RNA, 22 nt, Xenopus tropicalis
uacccuguagaaccgaauuugu

SEQ ID NO: 3926 - RNA, 22 nt, Xenopus tropicalis
cacccuguagaaucgaauuugu

SEQ ID NO: 3927 - RNA, 23 nt, Xenopus tropicalis
uggagugugacaaugguguuugu

SEQ ID NO: 3928 - RNA, 22 nt, Xenopus tropicalis
uuaaggcacgcggugaaugcca

SEQ ID NO: 3929 - RNA, 22 nt, Xenopus tropicalis
ucccugagacccuuaaccugug

SEQ ID NO: 3930 - RNA, 22 nt, Xenopus tropicalis
ucccugagacccuaacuuguga

SEQ ID NO: 3931 - RNA, 21 nt, Xenopus tropicalis
ucguaccgugaguaauaaugc

SEQ ID NO: 3932 - RNA, 21 nt, Xenopus tropicalis
cauuauuacuuuugguacgcg

SEQ ID NO: 3933 - RNA, 22 nt, Xenopus tropicalis
ucacagugaaccggucucuuuu

SEQ ID NO: 3934 - RNA, 21 nt, Xenopus tropicalis
cuuuuugcggucugggcuugc

SEQ ID NO: 3935 - RNA, 22 nt, Xenopus tropicalis
cagugcaauguuaaaagggcau

SEQ ID NO: 3936 - RNA, 22 nt, Xenopus tropicalis
cagugcaaugaugaaagggcau

SEQ ID NO: 3937 - RNA, 22 nt, Xenopus tropicalis
cagugcaauauuaaaagggcau

SEQ ID NO: 3938 - RNA, 22 nt, Xenopus tropicalis
uaacagucuacagccauggucg

SEQ ID NO: 3939 - RNA, 22 nt, Xenopus tropicalis
uugguccccuucaaccagcugu

SEQ ID NO: 3940 - RNA, 21 nt, Xenopus tropicalis
uugguccccuucaaccagcua

SEQ ID NO: 3941 - RNA, 22 nt, Xenopus tropicalis
uugguccccuucaaccagcugc

SEQ ID NO: 3942 - RNA, 22 nt, Xenopus tropicalis
uugguccccuucaaccagccgc

SEQ ID NO: 3943 - RNA, 23 nt, Xenopus tropicalis
uauggcuuuuuauuccuauguga

SEQ ID NO: 3944 - RNA, 22 nt, Xenopus tropicalis
uauugcuuaagaauacgcguag

SEQ ID NO: 3945 - RNA, 17 nt, Xenopus tropicalis
agcugguguugugaauc

SEQ ID NO: 3946 - RNA, 18 nt, Xenopus tropicalis
ucuacagugcaugugucu

SEQ ID NO: 3947 - RNA, 21 nt, Xenopus tropicalis
agugguuuuacccuaugguag

SEQ ID NO: 3948 - RNA, 23 nt, Xenopus tropicalis
uguaguguuuccuacuuuaugga

SEQ ID NO: 3949 - RNA, 20 nt, Xenopus tropicalis
cauaaaguagaaagcacuac

SEQ ID NO: 3950 - RNA, 22 nt, Xenopus tropicalis
ugagaugaagcacuguagcucg

SEQ ID NO: 3951 - RNA, 21 nt, Xenopus tropicalis
uacaguauagaugauguacua

SEQ ID NO: 3952 - RNA, 24 nt, Xenopus tropicalis
guccaguuuucccaggaaucccuu

SEQ ID NO: 3953 - RNA, 22 nt, Xenopus tropicalis
ugagaacugaauuccauagguu

SEQ ID NO: 3954 - RNA, 22 nt, Xenopus tropicalis
ucagugcacuacagaacuuugu

SEQ ID NO: 3955 - RNA, 22 nt, Xenopus tropicalis
ucagugcaucacagaacuuugu

SEQ ID NO: 3956 - RNA, 22 nt, Xenopus tropicalis
ucucccaacccuuguaccagag

SEQ ID NO: 3957 - RNA, 20 nt, Xenopus tropicalis
uugcauagucacaaaaguga

SEQ ID NO: 3958 - RNA, 22 nt, Xenopus tropicalis
uuaaugcuaaucgugauagggg

SEQ ID NO: 3959 - RNA, 22 nt, Xenopus tropicalis
uagcagcacauaaugguuugug

SEQ ID NO: 3960 - RNA, 22 nt, Xenopus tropicalis
uagcagcacaucaugauuugca

SEQ ID NO: 3961 - RNA, 22 nt, Xenopus tropicalis
uagcagcacaucaugguuugua

SEQ ID NO: 3962 - RNA, 22 nt, Xenopus tropicalis
uagcagcacguaaauauuggug

SEQ ID NO: 3963 - RNA, 22 nt, Xenopus tropicalis
uagcagcacguaaauauugggu

SEQ ID NO: 3964 - RNA, 22 nt, Xenopus tropicalis
uagcagcacguaaauacuggag

SEQ ID NO: 3965 - RNA, 20 nt, Xenopus tropicalis
acugcagugaaggcacuugu

SEQ ID NO: 3966 - RNA, 24 nt, Xenopus tropicalis
caaagugcuuacagugcagguagu

SEQ ID NO: 3967 - RNA, 23 nt, Xenopus tropicalis
aacauucaacgcugucggugagu

SEQ ID NO: 3968 - RNA, 22 nt, Xenopus tropicalis
accaucgaucguugacuguaca

SEQ ID NO: 3969 - RNA, 22 nt, Xenopus tropicalis
aacauucauugcugucgguggg

SEQ ID NO: 3970 - RNA, 22 nt, Xenopus tropicalis
uuuggcaaugguagaacucaca

SEQ ID NO: 3971 - RNA, 21 nt, Xenopus tropicalis
ugguucuagacuugccaacua

SEQ ID NO: 3972 - RNA, 23 nt, Xenopus tropicalis
uauggcacugguagaauucacug

SEQ ID NO: 3973 - RNA, 22 nt, Xenopus tropicalis
uggacggagaacugauaaggcu

SEQ ID NO: 3974 - RNA, 21 nt, Xenopus tropicalis
ucgugucuuguguugcagcca

SEQ ID NO: 3975 - RNA, 23 nt, Xenopus tropicalis
gugccuacugaacugauaucagu

SEQ ID NO: 3976 - RNA, 22 nt, Xenopus tropicalis
uaaggugcaucuagugcagaua

SEQ ID NO: 3977 - RNA, 23 nt, Xenopus tropicalis
uaaggugcaucuagugcaguuag

SEQ ID NO: 3978 - RNA, 22 nt, Xenopus tropicalis
caacggaaucccaaaagcagcu

SEQ ID NO: 3979 - RNA, 21 nt, Xenopus tropicalis
augaccuaugaauugacagcc

SEQ ID NO: 3980 - RNA, 24 nt, Xenopus tropicalis
aacuggcccgcaaagucccgcuuc

SEQ ID NO: 3981 - RNA, 22 nt, Xenopus tropicalis
uguaacagcaacuccaugugga

SEQ ID NO: 3982 - RNA, 21 nt, Xenopus tropicalis
uagguaguuucauguuguugg

SEQ ID NO: 3983 - RNA, 21 nt, Xenopus tropicalis
uagguaguuuuauguuguugg

SEQ ID NO: 3984 - RNA, 23 nt, Xenopus tropicalis
cccaguguucagacuaccuguuc

SEQ ID NO: 3985 - RNA, 22 nt, Xenopus tropicalis
uacaguagucugcacauugguu

SEQ ID NO: 3986 - RNA, 23 nt, Xenopus tropicalis
cccaguguucagacuacguguuc

SEQ ID NO: 3987 - RNA, 23 nt, Xenopus tropicalis
ugugcaaaucuaugcaaaacuga

SEQ ID NO: 3988 - RNA, 23 nt, Xenopus tropicalis
ugugcaaauccaugcaaaacuga

SEQ ID NO: 3989 - RNA, 21 nt, Xenopus tropicalis
uggaauguaaagaaguaugua

SEQ ID NO: 3990 - RNA, 21 nt, Xenopus tropicalis
uggaauguuaagaaguaugua

SEQ ID NO: 3991 - RNA, 22 nt, Xenopus tropicalis
uaacacugucugguaacgaugu

SEQ ID NO: 3992 - RNA, 23 nt, Xenopus tropicalis
uaauacugccugguaaugaugau

SEQ ID NO: 3993 - RNA, 22 nt, Xenopus tropicalis
aggggcauagggcaugggaaaa

SEQ ID NO: 3994 - RNA, 22 nt, Xenopus tropicalis
uuuccuaugcauauaccucuuu

SEQ ID NO: 3995 - RNA, 22 nt, Xenopus tropicalis
gugaaauguuuaggaccacuug

SEQ ID NO: 3996 - RNA, 22 nt, Xenopus tropicalis
uucccuuugucauccuaugccu

SEQ ID NO: 3997 - RNA, 22 nt, Xenopus tropicalis
uccuucauuccaccggagucug

SEQ ID NO: 3998 - RNA, 22 nt, Xenopus tropicalis
uccuucauuccaccggauccug

SEQ ID NO: 3999 - RNA, 22 nt, Xenopus tropicalis
uggaauguaaggaagugugugg

SEQ ID NO: 4000 - RNA, 22 nt, Xenopus tropicalis
auaagacgagcauaaagcuugu

SEQ ID NO: 4001 - RNA, 23 nt, Xenopus tropicalis
uaaagugcuuauagugcagguag

SEQ ID NO: 4002 - RNA, 21 nt, Xenopus tropicalis
acugcauaaugagcacuuaaa

SEQ ID NO: 4003 - RNA, 23 nt, Xenopus tropicalis
caaagugcucauagugcagguag

SEQ ID NO: 4004 - RNA, 22 nt, Xenopus tropicalis
cugugcgugugacagcggcuaa

SEQ ID NO: 4005 - RNA, 21 nt, Xenopus tropicalis
uaacagucuacagucauggcu

SEQ ID NO: 4006 - RNA, 21 nt, Xenopus tropicalis
acagcaggcacagacaggcag

SEQ ID NO: 4007 - RNA, 21 nt, Xenopus tropicalis
augaccuaugaaaugacagcc

SEQ ID NO: 4008 - RNA, 21 nt, Xenopus tropicalis
uaaucucagcuggcaacugug

SEQ ID NO: 4009 - RNA, 24 nt, Xenopus tropicalis
uacugcaucaggaacugauuggau

SEQ ID NO: 4010 - RNA, 21 nt, Xenopus tropicalis
uugugcuugaucuaaccaugu

SEQ ID NO: 4011 - RNA, 21 nt, Xenopus tropicalis
ugauuguccaaacgcaauucu

SEQ ID NO: 4012 - RNA, 22 nt, Xenopus tropicalis
aagcugccaguugaagaacugu

SEQ ID NO: 4013 - RNA, 21 nt, Xenopus tropicalis
aguucuucaguggcaagcuuu

SEQ ID NO: 4014 - RNA, 23 nt, Xenopus tropicalis
agcuacauugucugcuggguuuc

SEQ ID NO: 4015 - RNA, 24 nt, Xenopus tropicalis
agcuacaucuggcuacugggucuc

SEQ ID NO: 4016 - RNA, 21 nt, Xenopus tropicalis
ugucaguuugucaaauacccc

SEQ ID NO: 4017 - RNA, 21 nt, Xenopus tropicalis
aucacauugccagggauuucc

SEQ ID NO: 4018 - RNA, 21 nt, Xenopus tropicalis
aucacauugccagggauuacc

SEQ ID NO: 4019 - RNA, 22 nt, Xenopus tropicalis
uggcucaguucagcaggaacag

SEQ ID NO: 4020 - RNA, 21 nt, Xenopus tropicalis
uggcucaguucagcaggacag

SEQ ID NO: 4021 - RNA, 22 nt, Xenopus tropicalis
cauugcacuugucucggucuga

SEQ ID NO: 4022 - RNA, 21 nt, Xenopus tropicalis
uucaaguaauccaggauaggc

SEQ ID NO: 4023 - RNA, 21 nt, Xenopus tropicalis
uucacaguggcuaaguuccgc

SEQ ID NO: 4024 - RNA, 21 nt, Xenopus tropicalis
uucacaguggcuaaguucugc

SEQ ID NO: 4025 - RNA, 21 nt, Xenopus tropicalis
uucacaguggcuaaguuccac

SEQ ID NO: 4026 - RNA, 21 nt, Xenopus tropicalis
uagcaccauuugaaaucgguu

SEQ ID NO: 4027 - RNA, 23 nt, Xenopus tropicalis
uagcaccauuugaaaucaguguu

SEQ ID NO: 4028 - RNA, 20 nt, Xenopus tropicalis
uagcaccauuugaaaucggu

SEQ ID NO: 4029 - RNA, 22 nt, Xenopus tropicalis
ugaccgaucucucuugguguuc

SEQ ID NO: 4030 - RNA, 23 nt, Xenopus tropicalis
uagcaccauaugaaaucaguguc

SEQ ID NO: 4031 - RNA, 23 nt, Xenopus tropicalis
cagugcaauaguauugucaaagc

SEQ ID NO: 4032 - RNA, 23 nt, Xenopus tropicalis
uaagugcuccaauguuuuagugg

SEQ ID NO: 4033 - RNA, 22 nt, Xenopus tropicalis
cuuucagucagauguuugcagc

SEQ ID NO: 4034 - RNA, 22 nt, Xenopus tropicalis
uguaaacauccucgacuggaag

SEQ ID NO: 4035 - RNA, 22 nt, Xenopus tropicalis
uguaaacauccuacacucagcu

SEQ ID NO: 4036 - RNA, 23 nt, Xenopus tropicalis
uguaaacauccuacacucucagc

SEQ ID NO: 4037 - RNA, 22 nt, Xenopus tropicalis
uguaaacauccccgacuggaag

SEQ ID NO: 4038 - RNA, 20 nt, Xenopus tropicalis
uguaaacauccuugacugga

SEQ ID NO: 4039 - RNA, 22 nt, Xenopus tropicalis
aggcaagauguuggcauagcug

SEQ ID NO: 4040 - RNA, 22 nt, Xenopus tropicalis
uccagcaucagugauuuuguug

SEQ ID NO: 4041 - RNA, 19 nt, Xenopus tropicalis
gugcauuguaguugcauug

SEQ ID NO: 4042 - RNA, 19 nt, Xenopus tropicalis
gugcauuguuguugcauug

SEQ ID NO: 4043 - RNA, 23 nt, Xenopus tropicalis
uggcagugucuuagcugguuguu

SEQ ID NO: 4044 - RNA, 23 nt, Xenopus tropicalis
caggcaguguaguuagcugauug

SEQ ID NO: 4045 - RNA, 21 nt, Xenopus tropicalis
aauugcacgguauccaucugu

SEQ ID NO: 4046 - RNA, 22 nt, Xenopus tropicalis
cggguggaucacgaugcaauuu

SEQ ID NO: 4047 - RNA, 22 nt, Xenopus tropicalis
uaaugccccuaaaaauccuuau

SEQ ID NO: 4048 - RNA, 22 nt, Xenopus tropicalis
aauugcacuguagcaaugguga

SEQ ID NO: 4049 - RNA, 22 nt, Xenopus tropicalis
agaucagaaggugauuguggcu

SEQ ID NO: 4050 - RNA, 23 nt, Xenopus tropicalis
aaugacacgaucacucccguuga

SEQ ID NO: 4051 - RNA, 22 nt, Xenopus tropicalis
uaagugcucucuaguucgguug

SEQ ID NO: 4052 - RNA, 22 nt, Xenopus tropicalis
uaauacugucugguaaugccgu

SEQ ID NO: 4053 - RNA, 22 nt, Xenopus tropicalis
aggcaguguaauguuagcuggu

SEQ ID NO: 4054 - RNA, 22 nt, Xenopus tropicalis
aaaccguuaccauuacugaguu

SEQ ID NO: 4055 - RNA, 22 nt, Xenopus tropicalis
uaugugcccuuggacuacaucg

SEQ ID NO: 4056 - RNA, 23 nt, Xenopus tropicalis
agugacaucauauguacggcugc

SEQ ID NO: 4057 - RNA, 23 nt, Xenopus tropicalis
uuaagacuugcagugauguuuag

SEQ ID NO: 4058 - RNA, 22 nt, Xenopus tropicalis
uggaagacuagugauuuuguug

SEQ ID NO: 4059 - RNA, 22 nt, Xenopus tropicalis
ucuuugguuaucuagcuguaug

SEQ ID NO: 4060 - RNA, 21 nt, Xenopus tropicalis
uaaagcuagauaaccgaaagu

SEQ ID NO: 4061 - RNA, 21 nt, Xenopus tropicalis
uauugcacuugucccggccug

SEQ ID NO: 4062 - RNA, 21 nt, Xenopus tropicalis
uauugcacucgucccggccuc

SEQ ID NO: 4063 - RNA, 23 nt, Xenopus tropicalis
caaagugcuguucgugcagguag

SEQ ID NO: 4064 - RNA, 23 nt, Xenopus tropicalis
ucaagugcuguucgugcagguag

SEQ ID NO: 4065 - RNA, 23 nt, Xenopus tropicalis
uuuggcacuagcacauuuuugcu

SEQ ID NO: 4066 - RNA, 22 nt, Xenopus tropicalis
ugagguaguaaguuguauuguu

SEQ ID NO: 4067 - RNA, 22 nt, Xenopus tropicalis
aacccguagauccgaucuugug

SEQ ID NO: 4068 - RNA, 23 nt, Xenopus tropicalis
ucuuugguuaucuagcuguauga

SEQ ID NO: 4069 - RNA, 21 nt, Xenopus tropicalis
uaaagcuagauaaccgaaagu

SEQ ID NO: 4070 - RNA, 23 nt, Xenopus tropicalis
ucuuugguuaccuagcuguauga

SEQ ID NO: 4071 - RNA, 21 nt, Xenopus tropicalis
uaaagcuagacaaccgaacgu

SEQ ID NO: 4072 - RNA, 20 nt, Zea mays
ugacagaagagagugagcac

SEQ ID NO: 4073 - RNA, 20 nt, Zea mays
ugacagaagagagugagcac

SEQ ID NO: 4074 - RNA, 20 nt, Zea mays
ugacagaagagagugagcac

SEQ ID NO: 4075 - RNA, 20 nt, Zea mays
ugacagaagagagugagcac

SEQ ID NO: 4076 - RNA, 20 nt, Zea mays
ugacagaagagagugagcac

SEQ ID NO: 4077 - RNA, 20 nt, Zea mays
ugacagaagagagugagcac

SEQ ID NO: 4078 - RNA, 20 nt, Zea mays
ugacagaagagagugagcac

SEQ ID NO: 4079 - RNA, 20 nt, Zea mays
ugacagaagagagugagcac

SEQ ID NO: 4080 - RNA, 20 nt, Zea mays
ugacagaagagagugagcac

SEQ ID NO: 4081 - RNA, 21 nt, Zea mays
ugacagaagagagagagcaca

SEQ ID NO: 4082 - RNA, 20 nt, Zea mays
ugacagaagagagcgagcac

SEQ ID NO: 4083 - RNA, 21 nt, Zea mays
uuuggauugaagggagcucug

SEQ ID NO: 4084 - RNA, 21 nt, Zea mays
uuuggauugaagggagcucug

SEQ ID NO: 4085 - RNA, 21 nt, Zea mays
cuuggauugaagggagcuccu

SEQ ID NO: 4086 - RNA, 21 nt, Zea mays
cuuggauugaagggagcuccu

SEQ ID NO: 4087 - RNA, 21 nt, Zea mays
ugccuggcucccuguaugcca

SEQ ID NO: 4088 - RNA, 21 nt, Zea mays
ugccuggcucccuguaugcca

SEQ ID NO: 4089 - RNA, 21 nt, Zea mays
ugccuggcucccuguaugcca

SEQ ID NO: 4090 - RNA, 21 nt, Zea mays
ugccuggcucccuguaugcca

SEQ ID NO: 4091 - RNA, 21 nt, Zea mays
ugccuggcucccuguaugcca

SEQ ID NO: 4092 - RNA, 21 nt, Zea mays
ugccuggcucccuguaugccg

SEQ ID NO: 4093 - RNA, 20 nt, Zea mays
ucgauaaaccucugcaucca

SEQ ID NO: 4094 - RNA, 21 nt, Zea mays
uggagaagcagggcacgugca

SEQ ID NO: 4095 - RNA, 21 nt, Zea mays
uggagaagcagggcacgugca

SEQ ID NO: 4096 - RNA, 21 nt, Zea mays
uggagaagcagggcacgugca

SEQ ID NO: 4097 - RNA, 21 nt, Zea mays
uggagaagcagggcacgugca

SEQ ID NO: 4098 - RNA, 21 nt, Zea mays
ucggaccaggcuucauucccc

SEQ ID NO: 4099 - RNA, 20 nt, Zea mays
ucggaccaggcuucauuccc

SEQ ID NO: 4100 - RNA, 20 nt, Zea mays
ucggaccaggcuucauuccc

SEQ ID NO: 4101 - RNA, 20 nt, Zea mays
ucggaccaggcuucauuccc

SEQ ID NO: 4102 - RNA, 20 nt, Zea mays
ucggaccaggcuucauuccc

SEQ ID NO: 4103 - RNA, 20 nt, Zea mays
ucggaccaggcuucauuccc

SEQ ID NO: 4104 - RNA, 20 nt, Zea mays
ucggaccaggcuucauuccc

SEQ ID NO: 4105 - RNA, 20 nt, Zea mays
ucggaccaggcuucauuccc

SEQ ID NO: 4106 - RNA, 20 nt, Zea mays
ucggaccaggcuucauuccc

SEQ ID NO: 4107 - RNA, 21 nt, Zea mays
ucggaccaggcuucaaucccu

SEQ ID NO: 4108 - RNA, 21 nt, Zea mays
ucggaccaggcuucaaucccu

SEQ ID NO: 4109 - RNA, 21 nt, Zea mays
ucggaccaggcuucauuccuc

SEQ ID NO: 4110 - RNA, 21 nt, Zea mays
ucggaccaggcuucauuccuc

SEQ ID NO: 4111 - RNA, 21 nt, Zea mays
ugaagcugccagcaugaucua

SEQ ID NO: 4112 - RNA, 21 nt, Zea mays
ugaagcugccagcaugaucua

SEQ ID NO: 4113 - RNA, 21 nt, Zea mays
ugaagcugccagcaugaucua

SEQ ID NO: 4114 - RNA, 21 nt, Zea mays
ugaagcugccagcaugaucua

SEQ ID NO: 4115 - RNA, 21 nt, Zea mays
ugaagcugccagcaugaucug

SEQ ID NO: 4116 - RNA, 21 nt, Zea mays
ugaagcugccagcaugaucug

SEQ ID NO: 4117 - RNA, 21 nt, Zea mays
ugaagcugccagcaugaucug

SEQ ID NO: 4118 - RNA, 21 nt, Zea mays
ugaagcugccagcaugaucug

SEQ ID NO: 4119 - RNA, 21 nt, Zea mays
ugaagcugccagcaugaucug

SEQ ID NO: 4120 - RNA, 21 nt, Zea mays
ucgcuuggugcagaucgggac

SEQ ID NO: 4121 - RNA, 21 nt, Zea mays
ucgcuuggugcagaucgggac

SEQ ID NO: 4122 - RNA, 21 nt, Zea mays
cagccaaggaugacuugccga

SEQ ID NO: 4123 - RNA, 21 nt, Zea mays
cagccaaggaugacuugccga

SEQ ID NO: 4124 - RNA, 21 nt, Zea mays
cagccaaggaugacuugccgg

SEQ ID NO: 4125 - RNA, 21 nt, Zea mays
uagccaaggagacugccuaug

SEQ ID NO: 4126 - RNA, 21 nt, Zea mays
uagccaaggagacugccuacg

SEQ ID NO: 4127 - RNA, 21 nt, Zea mays
uagccaaggaugacuugccua

SEQ ID NO: 4128 - RNA, 21 nt, Zea mays
uagccaaggaugacuugccua

SEQ ID NO: 4129 - RNA, 21 nt, Zea mays
uagccaaggaugacuugccua

SEQ ID NO: 4130 - RNA, 21 nt, Zea mays
uagccaaggaugacuugccug

SEQ ID NO: 4131 - RNA, 21 nt, Zea mays
uagccaaggaugacuugccug

SEQ ID NO: 4132 - RNA, 21 nt, Zea mays
uagccaaggaugacuugccug

SEQ ID NO: 4133 - RNA, 20 nt, Zea mays
ugauugagccgcgccaauau

SEQ ID NO: 4134 - RNA, 20 nt, Zea mays
uugagccgugccaauaucac

SEQ ID NO: 4135 - RNA, 21 nt, Zea mays
ugacugagccgugccaauauc

SEQ ID NO: 4136 - RNA, 21 nt, Zea mays
ugauugagccgugccaauauc

SEQ ID NO: 4137 - RNA, 21 nt, Zea mays
ugauugagccgugccaauauc

SEQ ID NO: 4138 - RNA, 21 nt, Zea mays
uugagccgugccaauaucaca

SEQ ID NO: 4139 - RNA, 21 nt, Zea mays
gaggugagccgagccaauauc

SEQ ID NO: 4140 - RNA, 21 nt, Zea mays
gugagccgaaccaauaucacu

SEQ ID NO: 4141 - RNA, 21 nt, Zea mays
ugauugagccgugccaauauc

SEQ ID NO: 4142 - RNA, 21 nt, Zea mays
ugauugagccgugccaauauc

SEQ ID NO: 4143 - RNA, 21 nt, Zea mays
gugagccgaaccaauaucacu

SEQ ID NO: 4144 - RNA, 20 nt, Zea mays
agaaucuugaugaugcugca

SEQ ID NO: 4145 - RNA, 20 nt, Zea mays
agaaucuugaugaugcugca

SEQ ID NO: 4146 - RNA, 20 nt, Zea mays
agaaucuugaugaugcugca

SEQ ID NO: 4147 - RNA, 20 nt, Zea mays
agaaucuugaugaugcugca

SEQ ID NO: 4148 - RNA, 21 nt, Zea mays
ggaaucuugaugaugcugcau

SEQ ID NO: 4149 - RNA, 20 nt, Zea mays
uuggacugaagggugcuccc

SEQ ID NO: 4150 - RNA, 20 nt, Zea mays
uuggacugaagggugcuccc

SEQ ID NO: 4151 - RNA, 20 nt, Zea mays
uuggacugaagggugcuccc

SEQ ID NO: 4152 - RNA, 20 nt, Zea mays
uuggacugaagggugcuccc

SEQ ID NO: 4153 - RNA, 22 nt, Zea mays
uccaaagggaucgcauugaucu

SEQ ID NO: 4154 - RNA, 20 nt, Zea mays
uuggcauucuguccaccucc

SEQ ID NO: 4155 - RNA, 20 nt, Zea mays
uuggcauucuguccaccucc

SEQ ID NO: 4156 - RNA, 21 nt, Zea mays
gugaaguguuugggggaacuc

SEQ ID NO: 4157 - RNA, 21 nt, Zea mays
gugaaguguuugggggaacuc

SEQ ID NO: 4158 - RNA, 21 nt, Zea mays
gugaaguguuuggaggaacuc

SEQ ID NO: 4159 - RNA, 21 nt, Zea mays
uuccacagcuuucuugaacug

SEQ ID NO: 4160 - RNA, 21 nt, Zea mays
uuccacagcuuucuugaacug

SEQ ID NO: 4161 - RNA, 21 nt, Zea mays
ugccaaaggagaauugcccug

SEQ ID NO: 4162 - RNA, 21 nt, Zea mays
ugccaaaggagagcuguccug

SEQ ID NO: 4163 - RNA, 21 nt, Zea mays
ugccaaaggagaauugcccug

SEQ ID NO: 4164 - RNA, 21 nt, Zea mays
ugccaaaggagagcugcccug

SEQ ID NO: 4165 - RNA, 21 nt, Zea mays
ugccaaaggagaguugcccug

SEQ ID NO: 4166 - RNA, 21 nt, Zea mays
ugccaaaggaaauuugccccg

SEQ ID NO: 4167 - RNA, 21 nt, Zea mays
cugcacugccucuucccuggc

SEQ ID NO: 4168 - DNA, 28 bp, Artificial Sequence
  Synthetic
cagtcatttgggtgagatcactttgaaa

SEQ ID NO: 4169 - DNA, 28 bp, Artificial Sequence
  Synthetic
cagtcatttgggtgaggtagttggttgt

SEQ ID NO: 4170 - DNA, 28 bp, Artificial Sequence
  Synthetic
cagtcatttgggtggaatgtaaagaagt

SEQ ID NO: 4171 - DNA, 28 bp, Artificial Sequence
  Synthetic
cagtcatttgggaccctgtagatccgaa

SEQ ID NO: 4172 - DNA, 28 bp, Artificial Sequence
  Synthetic
cagtcatttgggaacccgtagatccgaa

SEQ ID NO: 4173 - DNA, 28 bp, Artificial Sequence
  Synthetic
cagtcatttgggtaaggcacgcggtgaa

SEQ ID NO: 4174 - DNA, 28 bp, Artificial Sequence
  Synthetic
cagtcatttgggtccctgagaccctaac

SEQ ID NO: 4175 - DNA, 28 bp, Artificial Sequence
  Synthetic
cagtcatttgggttggtccccttcaacc

SEQ ID NO: 4176 - DNA, 28 bp, Artificial Sequence
  Synthetic
cagtcatttgggtatcacagccattttg

SEQ ID NO: 4177 - DNA, 28 bp, Artificial Sequence
  Synthetic
cagtcatttgggtcagtctttttctctc

SEQ ID NO: 4178 - DNA, 28 bp, Artificial Sequence
  Synthetic
cagtcatttgggtggacggagaactgat

SEQ ID NO: 4179 - DNA, 28 bp, Artificial Sequence
  Synthetic
cagtcatttggggctcatcaaagctggc

SEQ ID NO: 4180 - DNA, 28 bp, Artificial Sequence
  Synthetic
cagtcatttgggttgtgcgtgtgacaac

SEQ ID NO: 4181 - DNA, 28 bp, Artificial Sequence
  Synthetic
cagtcatttgggtgattgtccaaacgca

SEQ ID NO: 4182 - DNA, 28 bp, Artificial Sequence
  Synthetic
cagtcatttgggtgtaatggcactggaa

SEQ ID NO: 4183 - DNA, 28 bp, Artificial Sequence
  Synthetic
cagtcatttgggtcaggtacctgaagta

SEQ ID NO: 4184 - DNA, 28 bp, Artificial Sequence
  Synthetic
cagtcatttgggcagcgaggtatagagt

SEQ ID NO: 4185 - DNA, 28 bp, Artificial Sequence
  Synthetic
cagtcatttgggtaaatgcactatctgg

SEQ ID NO: 4186 - DNA, 28 bp, Artificial Sequence
  Synthetic
cagtcatttgggtcggtgggactttcgt

SEQ ID NO: 4187 - DNA, 28 bp, Artificial Sequence
  Synthetic
cagtcatttgggtgactagatccacact

SEQ ID NO: 4188 - DNA, 28 bp, Artificial Sequence
  Synthetic
cagtcatttgggtgtcatggaattgctc

SEQ ID NO: 4189 - DNA, 28 bp, Artificial Sequence
  Synthetic
cagtcatttgggaatctagcctcttcta

SEQ ID NO: 4190 - DNA, 28 bp, Artificial Sequence
  Synthetic
cagtcatttgggtaaatatcagctggta

SEQ ID NO: 4191 - DNA, 28 bp, Artificial Sequence
  Synthetic
cagtcatttgggattgtacttcatcagg

SEQ ID NO: 4192 - DNA, 28 bp, Artificial Sequence
  Synthetic
cagtcatttgggtcacaacctccttgag

SEQ ID NO: 4193 - DNA, 28 bp, Artificial Sequence
  Synthetic
cagtcatttgggaatcacaggagtatac

SEQ ID NO: 4194 - DNA, 28 bp, Artificial Sequence
  Synthetic
cagtcatttgggttttgattgttgctca

SEQ ID NO: 4195 - DNA, 28 bp, Artificial Sequence
  Synthetic
cagtcatttgggtgaacacatctggtgg

SEQ ID NO: 4196 - DNA, 28 bp, Artificial Sequence
  Synthetic
cagtcatttgggtggaagactagtgatt

SEQ ID NO: 4197 - DNA, 28 bp, Artificial Sequence
  Synthetic
cagtcatttgggtaaagctagattacca

SEQ ID NO: 4198 - DNA, 28 bp, Artificial Sequence
  Synthetic
cagtcatttgggtaatactgtcaggtaa

SEQ ID NO: 4199 - DNA, 28 bp, Artificial Sequence
  Synthetic
cagtcatttgggtattgcacttgtcccg

SEQ ID NO: 4200 - DNA, 28 bp, Artificial Sequence
  Synthetic
cagtcatttgggaattgcacttgtcccg

SEQ ID NO: 4201 - DNA, 28 bp, Artificial Sequence
  Synthetic
cagtcatttgggtctttggttatctagc

SEQ ID NO: 4202 - DNA, 28 bp, Artificial Sequence
  Synthetic
cagtcatttgggactttggtgattttag

SEQ ID NO: 4203 - DNA, 28 bp, Artificial Sequence
  Synthetic
cagtcatttgggtctttggtattctagc

SEQ ID NO: 4204 - DNA, 28 bp, Artificial Sequence
  Synthetic
cagtcatttgggacgtatactgaatgta

SEQ ID NO: 4205 - DNA, 28 bp, Artificial Sequence
  Synthetic
cagtcatttgggaacccgtagatccgaa

SEQ ID NO: 4206 - DNA, 28 bp, Artificial Sequence
  Synthetic
cagtcatttgggtacagtactgtgataa

SEQ ID NO: 4207 - DNA, 28 bp, Artificial Sequence
  Synthetic
cagtcatttgggagcagcattgtacagg

SEQ ID NO: 4208 - DNA, 28 bp, Artificial Sequence
  Synthetic
cagtcatttgggaaaagtgcttacagtg

SEQ ID NO: 4209 - DNA, 28 bp, Artificial Sequence
  Synthetic
cagtcatttgggtaaagtgctgacagtg

SEQ ID NO: 4210 - DNA, 28 bp, Artificial Sequence
  Synthetic
cagtcatttgggtaccctgtagatccga

SEQ ID NO: 4211 - DNA, 28 bp, Artificial Sequence
  Synthetic
cagtcatttgggttaaggcacgcggtga

SEQ ID NO: 4212 - DNA, 28 bp, Artificial Sequence
  Synthetic
cagtcatttgggtccctgagaccctaac

SEQ ID NO: 4213 - DNA, 28 bp, Artificial Sequence
  Synthetic
cagtcatttgggtcggatccgtctgagc

SEQ ID NO: 4214 - DNA, 28 bp, Artificial Sequence
  Synthetic
cagtcatttgggtcacagtgaaccggtc

SEQ ID NO: 4215 - DNA, 28 bp, Artificial Sequence
  Synthetic
cagtcatttgggttggtccccttcaacc

SEQ ID NO: 4216 - DNA, 28 bp, Artificial Sequence
  Synthetic
cagtcatttgggtatggctttttattcc

SEQ ID NO: 4217 - DNA, 28 bp, Artificial Sequence
  Synthetic
cagtcatttgggtagcagcacataatgg

SEQ ID NO: 4218 - DNA, 28 bp, Artificial Sequence
  Synthetic
cagtcatttgggtagcagcacatcatgg

SEQ ID NO: 4219 - DNA, 28 bp, Artificial Sequence
  Synthetic
cagtcatttgggtagcagcacgtaaata

SEQ ID NO: 4220 - DNA, 28 bp, Artificial Sequence
  Synthetic
cagtcatttgggactgcagtgaaggcac

SEQ ID NO: 4221 - DNA, 28 bp, Artificial Sequence
  Synthetic
cagtcatttgggcaaagtgcttacagtg

SEQ ID NO: 4222 - DNA, 28 bp, Artificial Sequence
  Synthetic
cagtcatttgggtaaggtgcatctagtg

SEQ ID NO: 4223 - DNA, 28 bp, Artificial Sequence
  Synthetic
cagtcatttgggtgtaacagcaactcca

SEQ ID NO: 4224 - DNA, 28 bp, Artificial Sequence
  Synthetic
cagtcatttgggtaggtagtttcatgtt

SEQ ID NO: 4225 - DNA, 28 bp, Artificial Sequence
  Synthetic
cagtcatttgggttcaccaccttctcca

SEQ ID NO: 4226 - DNA, 28 bp, Artificial Sequence
  Synthetic
cagtcatttgggggtccagaggggagct

SEQ ID NO: 4227 - DNA, 28 bp, Artificial Sequence
  Synthetic
cagtcatttgggtgtgcaaatctatgca

SEQ ID NO: 4228 - DNA, 28 bp, Artificial Sequence
  Synthetic
cagtcatttgggtgtgcaaatccatgca

SEQ ID NO: 4229 - DNA, 28 bp, Artificial Sequence
  Synthetic
cagtcatttgggtaaagtgcttatagtg

SEQ ID NO: 4230 - DNA, 28 bp, Artificial Sequence
  Synthetic
cagtcatttgggtccttcattccaccgg

SEQ ID NO: 4231 - DNA, 28 bp, Artificial Sequence
  Synthetic
cagtcatttgggtagcttatcagactga

SEQ ID NO: 4232 - DNA, 28 bp, Artificial Sequence
  Synthetic
cagtcatttgggacagcaggcacagaca

SEQ ID NO: 4233 - DNA, 28 bp, Artificial Sequence
  Synthetic
cagtcatttgggttgtgcttgatctaac

SEQ ID NO: 4234 - DNA, 28 bp, Artificial Sequence
  Synthetic
cagtcatttgggaagctgccagttgaag

SEQ ID NO: 4235 - DNA, 28 bp, Artificial Sequence
  Synthetic
cagtcatttgggagctacatctggctac

SEQ ID NO: 4236 - DNA, 28 bp, Artificial Sequence
  Synthetic
cagtcatttgggatcacattgccaggga

SEQ ID NO: 4237 - DNA, 28 bp, Artificial Sequence
  Synthetic
cagtcatttgggttcacagtggctaagt

SEQ ID NO: 4238 - DNA, 28 bp, Artificial Sequence
  Synthetic
cagtcatttgggaaggagctcacagtct

SEQ ID NO: 4239 - DNA, 28 bp, Artificial Sequence
  Synthetic
cagtcatttgggctagcaccatctgaaa

SEQ ID NO: 4240 - DNA, 28 bp, Artificial Sequence
  Synthetic
cagtcatttgggtagcaccatttgaaat

SEQ ID NO: 4241 - DNA, 28 bp, Artificial Sequence
  Synthetic
cagtcatttgggtgtaaacatcctacac

SEQ ID NO: 4242 - DNA, 28 bp, Artificial Sequence
  Synthetic
cagtcatttgggtggcagtgtcttagct

SEQ ID NO: 4243 - DNA, 28 bp, Artificial Sequence
  Synthetic
cagtcatttgggtctttggttatctagc

SEQ ID NO: 4244 - DNA, 28 bp, Artificial Sequence
  Synthetic
cagtcatttgggtattgcacttgtcccg

SEQ ID NO: 4245 - DNA, 28 bp, Artificial Sequence
  Synthetic
cagtcatttgggaaagtgctgttcgtgc

SEQ ID NO: 4246 - DNA, 28 bp, Artificial Sequence
  Synthetic
cagtcatttgggtgaggtagtaagttgt

SEQ ID NO: 4247 - DNA, 28 bp, Artificial Sequence
  Synthetic
cagtcatttgggtgagatcattgtgaaa

SEQ ID NO: 4248 - DNA, 28 bp, Artificial Sequence
  Synthetic
cagtcatttgggtggaatgtaaagaagt

SEQ ID NO: 4249 - DNA, 28 bp, Artificial Sequence
  Synthetic
cagtcatttgggtgagtattacatcagg

SEQ ID NO: 4250 - DNA, 28 bp, Artificial Sequence
  Synthetic
cagtcatttgggtaaggcacgcggtgaa

SEQ ID NO: 4251 - DNA, 28 bp, Artificial Sequence
  Synthetic
cagtcatttgggcccctgagaccctaac

SEQ ID NO: 4252 - DNA, 28 bp, Artificial Sequence
  Synthetic
cagtcatttgggttggtccccttcaacc

SEQ ID NO: 4253 - DNA, 28 bp, Artificial Sequence
  Synthetic
cagtcatttgggtggacggagaactgat

SEQ ID NO: 4254 - DNA, 28 bp, Artificial Sequence
  Synthetic
cagtcatttgggtatcacagccagcttt

SEQ ID NO: 4255 - DNA, 28 bp, Artificial Sequence
  Synthetic
cagtcatttgggttgtgcgtgtgacagc

SEQ ID NO: 4256 - DNA, 28 bp, Artificial Sequence
  Synthetic
cagtcatttgggtgattgtccaaacgca

SEQ ID NO: 4257 - DNA, 28 bp, Artificial Sequence
  Synthetic
cagtcatttggggtaaatggcactggaa

SEQ ID NO: 4258 - DNA, 28 bp, Artificial Sequence
  Synthetic
cagtcatttgggtaggaacttcataccg

SEQ ID NO: 4259 - DNA, 28 bp, Artificial Sequence
  Synthetic
cagtcatttgggtaaatgcactatctgg

SEQ ID NO: 4260 - DNA, 28 bp, Artificial Sequence
  Synthetic
cagtcatttgggtcggtgggactttcgt

SEQ ID NO: 4261 - DNA, 28 bp, Artificial Sequence
  Synthetic
cagtcatttgggtgtcatggagttgctc

SEQ ID NO: 4262 - DNA, 28 bp, Artificial Sequence
  Synthetic
cagtcatttggggatttagcctctccta

SEQ ID NO: 4263 - DNA, 28 bp, Artificial Sequence
  Synthetic
cagtcatttgggattgtacttcatcagg

SEQ ID NO: 4264 - DNA, 28 bp, Artificial Sequence
  Synthetic
cagtcatttgggttttgattgttgctca

SEQ ID NO: 4265 - DNA, 28 bp, Artificial Sequence
  Synthetic
cagtcatttgggtgaacacagctggtgg

SEQ ID NO: 4266 - DNA, 28 bp, Artificial Sequence
  Synthetic
cagtcatttgggtggaagactagtgatt

SEQ ID NO: 4267 - DNA, 28 bp, Artificial Sequence
  Synthetic
cagtcatttgggtaatactgtcaggtaa

SEQ ID NO: 4268 - DNA, 28 bp, Artificial Sequence
  Synthetic
cagtcatttgggtctttggttatctagc

SEQ ID NO: 4269 - DNA, 28 bp, Artificial Sequence
  Synthetic
cagtcatttggggctttggtaatctagc

SEQ ID NO: 4270 - DNA, 28 bp, Artificial Sequence
  Synthetic
cagtcatttgggacgtatactgaatgta

SEQ ID NO: 4271 - DNA, 28 bp, Artificial Sequence
  Synthetic
cagtcatttgggtgacagaagagagtga

SEQ ID NO: 4272 - DNA, 28 bp, Artificial Sequence
  Synthetic
cagtcatttgggtgacagaagagagtga

SEQ ID NO: 4273 - DNA, 28 bp, Artificial Sequence
  Synthetic
cagtcatttgggtgacagaagagagtga

SEQ ID NO: 4274 - DNA, 28 bp, Artificial Sequence
  Synthetic
cagtcatttgggtgacagaagagagtga

SEQ ID NO: 4275 - DNA, 28 bp, Artificial Sequence
  Synthetic
cagtcatttgggtgacagaagagagtga

SEQ ID NO: 4276 - DNA, 28 bp, Artificial Sequence
  Synthetic
cagtcatttgggtgacagaagagagtga

SEQ ID NO: 4277 - DNA, 28 bp, Artificial Sequence
  Synthetic
cagtcatttgggcgacagaagagagtga

SEQ ID NO: 4278 - DNA, 28 bp, Artificial Sequence
  Synthetic
cagtcatttgggttgacagaagaaagag

SEQ ID NO: 4279 - DNA, 28 bp, Artificial Sequence
  Synthetic
cagtcatttgggttgacagaagatagag

SEQ ID NO: 4280 - DNA, 28 bp, Artificial Sequence
  Synthetic
cagtcatttgggttgacagaagatagag

SEQ ID NO: 4281 - DNA, 28 bp, Artificial Sequence
  Synthetic
cagtcatttgggttgacagaagatagag

SEQ ID NO: 4282 - DNA, 28 bp, Artificial Sequence
  Synthetic
cagtcatttgggtgacagaagatagaga

SEQ ID NO: 4283 - DNA, 28 bp, Artificial Sequence
  Synthetic
cagtcatttgggtcccaaatgtagacaa

SEQ ID NO: 4284 - DNA, 28 bp, Artificial Sequence
  Synthetic
cagtcatttgggccccaaatgtagacaa

SEQ ID NO: 4285 - DNA, 28 bp, Artificial Sequence
  Synthetic
cagtcatttgggtttggattgaagggag

SEQ ID NO: 4286 - DNA, 28 bp, Artificial Sequence
  Synthetic
cagtcatttgggtttggattgaagggag

SEQ ID NO: 4287 - DNA, 28 bp, Artificial Sequence
  Synthetic
cagtcatttgggtttggattgaagggag

SEQ ID NO: 4288 - DNA, 28 bp, Artificial Sequence
  Synthetic
cagtcatttgggtgcctggctccctgta

SEQ ID NO: 4289 - DNA, 28 bp, Artificial Sequence
  Synthetic
cagtcatttgggtgcctggctccctgta

SEQ ID NO: 4290 - DNA, 28 bp, Artificial Sequence
  Synthetic
cagtcatttgggtgcctggctccctgta

SEQ ID NO: 4291 - DNA, 28 bp, Artificial Sequence
  Synthetic
cagtcatttgggttgaaagtgactacat

SEQ ID NO: 4292 - DNA, 28 bp, Artificial Sequence
  Synthetic
cagtcatttgggtcgataaacctctgca

SEQ ID NO: 4293 - DNA, 28 bp, Artificial Sequence
  Synthetic
cagtcatttgggtcgataaacctctgca

SEQ ID NO: 4294 - DNA, 28 bp, Artificial Sequence
  Synthetic
cagtcatttgggttgaagaggacttgga

SEQ ID NO: 4295 - DNA, 28 bp, Artificial Sequence
  Synthetic
cagtcatttgggtggagaagcagggcac

SEQ ID NO: 4296 - DNA, 28 bp, Artificial Sequence
  Synthetic
cagtcatttgggtggagaagcagggcac

SEQ ID NO: 4297 - DNA, 28 bp, Artificial Sequence
  Synthetic
cagtcatttgggtggagaagcagggcac

SEQ ID NO: 4298 - DNA, 28 bp, Artificial Sequence
  Synthetic
cagtcatttgggtcggaccaggcttcat

SEQ ID NO: 4299 - DNA, 28 bp, Artificial Sequence
  Synthetic
cagtcatttgggtcggaccaggcttcat

SEQ ID NO: 4300 - DNA, 28 bp, Artificial Sequence
  Synthetic
cagtcatttgggtcggaccaggcttcat

SEQ ID NO: 4301 - DNA, 28 bp, Artificial Sequence
  Synthetic
cagtcatttgggtcggaccaggcttcat

SEQ ID NO: 4302 - DNA, 28 bp, Artificial Sequence
  Synthetic
cagtcatttgggtcggaccaggcttcat

SEQ ID NO: 4303 - DNA, 28 bp, Artificial Sequence
  Synthetic
cagtcatttgggtcggaccaggcttcat

SEQ ID NO: 4304 - DNA, 28 bp, Artificial Sequence
  Synthetic
cagtcatttgggtcggaccaggcttcat

SEQ ID NO: 4305 - DNA, 28 bp, Artificial Sequence
  Synthetic
cagtcatttgggtcggaccaggcttcat

SEQ ID NO: 4306 - DNA, 28 bp, Artificial Sequence
  Synthetic
cagtcatttgggtcggaccaggcttcat

SEQ ID NO: 4307 - DNA, 28 bp, Artificial Sequence
  Synthetic
cagtcatttgggtgaagctgccagcatg

SEQ ID NO: 4308 - DNA, 28 bp, Artificial Sequence
  Synthetic
cagtcatttgggtgaagctgccagcatg

SEQ ID NO: 4309 - DNA, 28 bp, Artificial Sequence
  Synthetic
cagtcatttgggttaagctgccagcatg

SEQ ID NO: 4310 - DNA, 28 bp, Artificial Sequence
  Synthetic
cagtcatttgggtgaagctgccagcatg

SEQ ID NO: 4311 - DNA, 28 bp, Artificial Sequence
  Synthetic
cagtcatttgggtcgcttggtgcaggtc

SEQ ID NO: 4312 - DNA, 28 bp, Artificial Sequence
  Synthetic
cagtcatttgggtcgcttggtgcaggtc

SEQ ID NO: 4313 - DNA, 28 bp, Artificial Sequence
  Synthetic
cagtcatttgggcagccaaggatgactt

SEQ ID NO: 4314 - DNA, 28 bp, Artificial Sequence
  Synthetic
cagtcatttgggcagccaaggatgactt

SEQ ID NO: 4315 - DNA, 28 bp, Artificial Sequence
  Synthetic
cagtcatttgggcagccaaggatgactt

SEQ ID NO: 4316 - DNA, 28 bp, Artificial Sequence
  Synthetic
cagtcatttgggtgagccaaggatgact

SEQ ID NO: 4317 - DNA, 28 bp, Artificial Sequence
  Synthetic
cagtcatttgggtgagccaaggatgact

SEQ ID NO: 4318 - DNA, 28 bp, Artificial Sequence
  Synthetic
cagtcatttgggtgagccaaggatgact

SEQ ID NO: 4319 - DNA, 28 bp, Artificial Sequence
  Synthetic
cagtcatttgggtgagccaaggatgact

SEQ ID NO: 4320 - DNA, 28 bp, Artificial Sequence
  Synthetic
cagtcatttgggtccggcaagttgacct

SEQ ID NO: 4321 - DNA, 28 bp, Artificial Sequence
  Synthetic
cagtcatttgggtagccaaggatgactt

SEQ ID NO: 4322 - DNA, 28 bp, Artificial Sequence
  Synthetic
cagtcatttgggtagccaaggatgactt

SEQ ID NO: 4323 - DNA, 28 bp, Artificial Sequence
  Synthetic
cagtcatttgggtagccaaggatgactt

SEQ ID NO: 4324 - DNA, 28 bp, Artificial Sequence
  Synthetic
cagtcatttgggtagccaaggatgactt

SEQ ID NO: 4325 - DNA, 28 bp, Artificial Sequence
  Synthetic
cagtcatttgggtagccaaggatgactt

SEQ ID NO: 4326 - DNA, 28 bp, Artificial Sequence
  Synthetic
cagtcatttgggtagccaaggatgactt

SEQ ID NO: 4327 - DNA, 28 bp, Artificial Sequence
  Synthetic
cagtcatttgggtagccaaggatgactt

SEQ ID NO: 4328 - DNA, 28 bp, Artificial Sequence
  Synthetic
cagtcatttgggtgattgagccgtgtca

SEQ ID NO: 4329 - DNA, 28 bp, Artificial Sequence
  Synthetic
cagtcatttgggtgattgagccgcgcca

SEQ ID NO: 4330 - DNA, 28 bp, Artificial Sequence
  Synthetic
cagtcatttgggttgagccgtgccaata

SEQ ID NO: 4331 - DNA, 28 bp, Artificial Sequence
  Synthetic
cagtcatttgggttgagccgtgccaata

SEQ ID NO: 4332 - DNA, 28 bp, Artificial Sequence
  Synthetic
cagtcatttgggagaatcttgatgatgc

SEQ ID NO: 4333 - DNA, 28 bp, Artificial Sequence
  Synthetic
cagtcatttgggagaatcttgatgatgc

SEQ ID NO: 4334 - DNA, 28 bp, Artificial Sequence
  Synthetic
cagtcatttggggcagcaccattaagat

SEQ ID NO: 4335 - DNA, 28 bp, Artificial Sequence
  Synthetic
cagtcatttgggagaatcttgatgatgc

SEQ ID NO: 4336 - DNA, 28 bp, Artificial Sequence
  Synthetic
cagtcatttgggagaatcttgatgatgc

SEQ ID NO: 4337 - DNA, 28 bp, Artificial Sequence
  Synthetic
cagtcatttgggggaatcttgatgatgc

SEQ ID NO: 4338 - DNA, 28 bp, Artificial Sequence
  Synthetic
cagtcatttgggttcgcttgcagagaga

SEQ ID NO: 4339 - DNA, 28 bp, Artificial Sequence
  Synthetic
cagtcatttgggttggactgaagggagc

SEQ ID NO: 4340 - DNA, 28 bp, Artificial Sequence
  Synthetic
cagtcatttgggttggactgaagggagc

SEQ ID NO: 4341 - DNA, 28 bp, Artificial Sequence
  Synthetic
cagtcatttgggttggactgaagggagc

SEQ ID NO: 4342 - DNA, 28 bp, Artificial Sequence
  Synthetic
cagtcatttgggaagctcaggagggata

SEQ ID NO: 4343 - DNA, 28 bp, Artificial Sequence
  Synthetic
cagtcatttgggaagctcaggagggata

SEQ ID NO: 4344 - DNA, 28 bp, Artificial Sequence
  Synthetic
cagtcatttgggttcgcaggagagatag

SEQ ID NO: 4345 - DNA, 28 bp, Artificial Sequence
  Synthetic
cagtcatttgggtccaaagggatcgcat

SEQ ID NO: 4346 - DNA, 28 bp, Artificial Sequence
  Synthetic
cagtcatttgggtccaaagggatcgcat

SEQ ID NO: 4347 - DNA, 28 bp, Artificial Sequence
  Synthetic
cagtcatttgggttggcattctgtccac

SEQ ID NO: 4348 - DNA, 28 bp, Artificial Sequence
  Synthetic
cagtcatttgggttggcattctgtccac

SEQ ID NO: 4349 - DNA, 28 bp, Artificial Sequence
  Synthetic
cagtcatttgggctgaagtgtttggggg

SEQ ID NO: 4350 - DNA, 28 bp, Artificial Sequence
  Synthetic
cagtcatttgggctgaagtgtttggggg

SEQ ID NO: 4351 - DNA, 28 bp, Artificial Sequence
  Synthetic
cagtcatttgggctgaagtgtttggggg

SEQ ID NO: 4352 - DNA, 28 bp, Artificial Sequence
  Synthetic
cagtcatttgggctgaagtgtttggggg

SEQ ID NO: 4353 - DNA, 28 bp, Artificial Sequence
  Synthetic
cagtcatttgggctgaagtgtttggggg

SEQ ID NO: 4354 - DNA, 28 bp, Artificial Sequence
  Synthetic
cagtcatttgggctgaagtgtttggggg

SEQ ID NO: 4355 - DNA, 28 bp, Artificial Sequence
  Synthetic
cagtcatttgggttccacagctttcttg

SEQ ID NO: 4356 - DNA, 28 bp, Artificial Sequence
  Synthetic
cagtcatttgggttccacagctttcttg

SEQ ID NO: 4357 - DNA, 28 bp, Artificial Sequence
  Synthetic
cagtcatttgggtcattgagtgcagcgt

SEQ ID NO: 4358 - DNA, 28 bp, Artificial Sequence
  Synthetic
cagtcatttgggtcattgagtgcatcgt

SEQ ID NO: 4359 - DNA, 28 bp, Artificial Sequence
  Synthetic
cagtcatttgggtgtgttctcaggtcac

SEQ ID NO: 4360 - DNA, 28 bp, Artificial Sequence
  Synthetic
cagtcatttgggtgtgttctcaggtcac

SEQ ID NO: 4361 - DNA, 28 bp, Artificial Sequence
  Synthetic
cagtcatttgggtgtgttctcaggtcac

SEQ ID NO: 4362 - DNA, 28 bp, Artificial Sequence
  Synthetic
cagtcatttgggtgccaaaggagatttg

SEQ ID NO: 4363 - DNA, 28 bp, Artificial Sequence
  Synthetic
cagtcatttgggtgccaaaggagagttg

SEQ ID NO: 4364 - DNA, 28 bp, Artificial Sequence
  Synthetic
cagtcatttgggtgccaaaggagagttg

SEQ ID NO: 4365 - DNA, 28 bp, Artificial Sequence
  Synthetic
cagtcatttgggtgccaaaggagatttg

SEQ ID NO: 4366 - DNA, 28 bp, Artificial Sequence
  Synthetic
cagtcatttgggtgccaaaggagatttg

SEQ ID NO: 4367 - DNA, 28 bp, Artificial Sequence
  Synthetic
cagtcatttgggtgccaaaggagatttg

SEQ ID NO: 4368 - DNA, 28 bp, Artificial Sequence
  Synthetic
cagtcatttgggtatgagagtattataa

SEQ ID NO: 4369 - DNA, 28 bp, Artificial Sequence
  Synthetic
cagtcatttgggcgaaactggtgtcgac

SEQ ID NO: 4370 - DNA, 28 bp, Artificial Sequence
  Synthetic
cagtcatttgggttcgaggcctattaaa

SEQ ID NO: 4371 - DNA, 28 bp, Artificial Sequence
  Synthetic
cagtcatttgggttagattcacgcacaa

SEQ ID NO: 4372 - DNA, 28 bp, Artificial Sequence
  Synthetic
cagtcatttgggattaacgctggcggtt

SEQ ID NO: 4373 - DNA, 28 bp, Artificial Sequence
  Synthetic
cagtcatttgggatgagttgggtctaac

SEQ ID NO: 4374 - DNA, 28 bp, Artificial Sequence
  Synthetic
cagtcatttgggatgagttgggtctaac

SEQ ID NO: 4375 - DNA, 28 bp, Artificial Sequence
  Synthetic
cagtcatttgggatgagttgggtctaac

SEQ ID NO: 4376 - DNA, 28 bp, Artificial Sequence
  Synthetic
cagtcatttgggtagaatgctattgtaa

SEQ ID NO: 4377 - DNA, 28 bp, Artificial Sequence
  Synthetic
cagtcatttgggtttaaatcatatactt

SEQ ID NO: 4378 - DNA, 28 bp, Artificial Sequence
  Synthetic
cagtcatttgggatgcactgcctcttcc

SEQ ID NO: 4379 - DNA, 28 bp, Artificial Sequence
  Synthetic
cagtcatttgggatagtttctcttgttc

SEQ ID NO: 4380 - DNA, 28 bp, Artificial Sequence
  Synthetic
cagtcatttgggtcatcttcatcatcat

SEQ ID NO: 4381 - DNA, 28 bp, Artificial Sequence
  Synthetic
cagtcatttgggaacagagcagaaacag

SEQ ID NO: 4382 - DNA, 28 bp, Artificial Sequence
  Synthetic
cagtcatttgggggttcgtacgtacact

SEQ ID NO: 4383 - DNA, 28 bp, Artificial Sequence
  Synthetic
cagtcatttggggaaggtagtgaatttg

SEQ ID NO: 4384 - DNA, 28 bp, Artificial Sequence
  Synthetic
cagtcatttgggtaatgtgatgatgaac

SEQ ID NO: 4385 - DNA, 28 bp, Artificial Sequence
  Synthetic
cagtcatttgggttatgaatgctgagga

SEQ ID NO: 4386 - DNA, 28 bp, Artificial Sequence
  Synthetic
cagtcatttgggtaaactaatcacggaa

SEQ ID NO: 4387 - DNA, 28 bp, Artificial Sequence
  Synthetic
cagtcatttgggttttggaaatttgtcc

SEQ ID NO: 4388 - DNA, 28 bp, Artificial Sequence
  Synthetic
cagtcatttgggttggggacgagatgtt

SEQ ID NO: 4389 - DNA, 28 bp, Artificial Sequence
  Synthetic
cagtcatttgggttggggacgagatgtt

SEQ ID NO: 4390 - DNA, 28 bp, Artificial Sequence
  Synthetic
cagtcatttgggttggggacgacatctt

SEQ ID NO: 4391 - DNA, 28 bp, Artificial Sequence
  Synthetic
cagtcatttgggtgagcctctgtggtag

SEQ ID NO: 4392 - DNA, 28 bp, Artificial Sequence
  Synthetic
cagtcatttgggtttttcctactccgcc

SEQ ID NO: 4393 - DNA, 28 bp, Artificial Sequence
  Synthetic
cagtcatttgggtttgcttccagctttt

SEQ ID NO: 4394 - DNA, 28 bp, Artificial Sequence
  Synthetic
cagtcatttgggttggttacccatatgg

SEQ ID NO: 4395 - DNA, 28 bp, Artificial Sequence
  Synthetic
cagtcatttgggttcgatgtctagcagt

SEQ ID NO: 4396 - DNA, 28 bp, Artificial Sequence
  Synthetic
cagtcatttgggtctaagtcttctattg

SEQ ID NO: 4397 - DNA, 28 bp, Artificial Sequence
  Synthetic
cagtcatttgggtacgcattgagtttcg

SEQ ID NO: 4398 - DNA, 28 bp, Artificial Sequence
  Synthetic
cagtcatttgggtggcttggtttatgta

SEQ ID NO: 4399 - DNA, 28 bp, Artificial Sequence
  Synthetic
cagtcatttgggttctgctatgttgctg

SEQ ID NO: 4400 - DNA, 28 bp, Artificial Sequence
  Synthetic
cagtcatttgggtttcttcgtgaatatc

SEQ ID NO: 4401 - DNA, 28 bp, Artificial Sequence
  Synthetic
cagtcatttgggttagagttttctggat

SEQ ID NO: 4402 - DNA, 28 bp, Artificial Sequence
  Synthetic
cagtcatttgggacaaacaccttggatg

SEQ ID NO: 4403 - DNA, 28 bp, Artificial Sequence
  Synthetic
cagtcatttgggaagctttgctcgttca

SEQ ID NO: 4404 - DNA, 28 bp, Artificial Sequence
  Synthetic
cagtcatttgggtgaggtagtaggttgt

SEQ ID NO: 4405 - DNA, 28 bp, Artificial Sequence
  Synthetic
cagtcatttgggtggaatgtaaagaagt

SEQ ID NO: 4406 - DNA, 28 bp, Artificial Sequence
  Synthetic
cagtcatttgggaccctgtagatccgaa

SEQ ID NO: 4407 - DNA, 28 bp, Artificial Sequence
  Synthetic
cagtcatttgggtaaggcacgcggtgaa

SEQ ID NO: 4408 - DNA, 28 bp, Artificial Sequence
  Synthetic
cagtcatttgggtcagtctttttctctc

SEQ ID NO: 4409 - DNA, 28 bp, Artificial Sequence
  Synthetic
cagtcatttgggaatggcactggaagaa

SEQ ID NO: 4410 - DNA, 28 bp, Artificial Sequence
  Synthetic
cagtcatttgggcttggcactgggagaa

SEQ ID NO: 4411 - DNA, 28 bp, Artificial Sequence
  Synthetic
cagtcatttgggtcaggtacctgaagta

SEQ ID NO: 4412 - DNA, 28 bp, Artificial Sequence
  Synthetic
cagtcatttgggagcgaggtatagagtt

SEQ ID NO: 4413 - DNA, 28 bp, Artificial Sequence
  Synthetic
cagtcatttgggtaaatgcactatctgg

SEQ ID NO: 4414 - DNA, 28 bp, Artificial Sequence
  Synthetic
cagtcatttgggtgactagatccacact

SEQ ID NO: 4415 - DNA, 28 bp, Artificial Sequence
  Synthetic
cagtcatttgggacctagcctctccttg

SEQ ID NO: 4416 - DNA, 28 bp, Artificial Sequence
  Synthetic
cagtcatttgggtaaatatcagctggta

SEQ ID NO: 4417 - DNA, 28 bp, Artificial Sequence
  Synthetic
cagtcatttgggattgtacttcatcagg

SEQ ID NO: 4418 - DNA, 28 bp, Artificial Sequence
  Synthetic
cagtcatttgggtcacaacctccttgag

SEQ ID NO: 4419 - DNA, 28 bp, Artificial Sequence
  Synthetic
cagtcatttgggggcaagaagtcggcat

SEQ ID NO: 4420 - DNA, 28 bp, Artificial Sequence
  Synthetic
cagtcatttgggtggcagtgtggttagc

SEQ ID NO: 4421 - DNA, 28 bp, Artificial Sequence
  Synthetic
cagtcatttgggtggaagactagtgatt

SEQ ID NO: 4422 - DNA, 28 bp, Artificial Sequence
  Synthetic
cagtcatttgggtgaaagacatgggtag

SEQ ID NO: 4423 - DNA, 28 bp, Artificial Sequence
  Synthetic
cagtcatttgggtaatactgtcaggtaa

SEQ ID NO: 4424 - DNA, 28 bp, Artificial Sequence
  Synthetic
cagtcatttgggtctttggttatctagc

SEQ ID NO: 4425 - DNA, 28 bp, Artificial Sequence
  Synthetic
cagtcatttgggtgaggtagtaggttgt

SEQ ID NO: 4426 - DNA, 28 bp, Artificial Sequence
  Synthetic
cagtcatttgggagaggtagtaggttgc

SEQ ID NO: 4427 - DNA, 28 bp, Artificial Sequence
  Synthetic
cagtcatttgggtgaggtagtagattgt

SEQ ID NO: 4428 - DNA, 28 bp, Artificial Sequence
  Synthetic
cagtcatttgggtgaggtagtagtttgt

SEQ ID NO: 4429 - DNA, 28 bp, Artificial Sequence
  Synthetic
cagtcatttgggtgaggtagtagtttgt

SEQ ID NO: 4430 - DNA, 28 bp, Artificial Sequence
  Synthetic
cagtcatttgggtacagtactgtgataa

SEQ ID NO: 4431 - DNA, 28 bp, Artificial Sequence
  Synthetic
cagtcatttgggagcagcattgtacagg

SEQ ID NO: 4432 - DNA, 28 bp, Artificial Sequence
  Synthetic
cagtcatttgggaaaagtgcttacagtg

SEQ ID NO: 4433 - DNA, 28 bp, Artificial Sequence
  Synthetic
cagtcatttgggagcagcattgtacagg

SEQ ID NO: 4434 - DNA, 28 bp, Artificial Sequence
  Synthetic
cagtcatttgggtaccctgtagatccga

SEQ ID NO: 4435 - DNA, 28 bp, Artificial Sequence
  Synthetic
cagtcatttgggtaccctgtagaaccga

SEQ ID NO: 4436 - DNA, 28 bp, Artificial Sequence
  Synthetic
cagtcatttgggtggagtgtgacaatgg

SEQ ID NO: 4437 - DNA, 28 bp, Artificial Sequence
  Synthetic
cagtcatttgggttaaggcacgcggtga

SEQ ID NO: 4438 - DNA, 28 bp, Artificial Sequence
  Synthetic
cagtcatttgggtccctgagacccttta

SEQ ID NO: 4439 - DNA, 28 bp, Artificial Sequence
  Synthetic
cagtcatttgggtccctgagaccctaac

SEQ ID NO: 4440 - DNA, 28 bp, Artificial Sequence
  Synthetic
cagtcatttgggcgtaccgtgagtaata

SEQ ID NO: 4441 - DNA, 28 bp, Artificial Sequence
  Synthetic
cagtcatttgggtcggatccgtctgagc

SEQ ID NO: 4442 - DNA, 28 bp, Artificial Sequence
  Synthetic
cagtcatttgggtcacagtgaaccggtc

SEQ ID NO: 4443 - DNA, 28 bp, Artificial Sequence
  Synthetic
cagtcatttgggtaacagtctacagcca

SEQ ID NO: 4444 - DNA, 28 bp, Artificial Sequence
  Synthetic
cagtcatttgggagctggtgttgtgaat

SEQ ID NO: 4445 - DNA, 28 bp, Artificial Sequence
  Synthetic
cagtcatttgggtctacagtgcacgtgt

SEQ ID NO: 4446 - DNA, 28 bp, Artificial Sequence
  Synthetic
cagtcatttgggtaccacagggtagaac

SEQ ID NO: 4447 - DNA, 28 bp, Artificial Sequence
  Synthetic
cagtcatttgggcataaagtagaaagca

SEQ ID NO: 4448 - DNA, 28 bp, Artificial Sequence
  Synthetic
cagtcatttgggagtgtttcctacttta

SEQ ID NO: 4449 - DNA, 28 bp, Artificial Sequence
  Synthetic
cagtcatttggggtccagttttcccagg

SEQ ID NO: 4450 - DNA, 28 bp, Artificial Sequence
  Synthetic
cagtcatttgggtcagtgcactacagaa

SEQ ID NO: 4451 - DNA, 28 bp, Artificial Sequence
  Synthetic
cagtcatttgggtcagtgcatcacagaa

SEQ ID NO: 4452 - DNA, 28 bp, Artificial Sequence
  Synthetic
cagtcatttgggtctcccaacccttgta

SEQ ID NO: 4453 - DNA, 28 bp, Artificial Sequence
  Synthetic
cagtcatttgggctagactgaagctcct

SEQ ID NO: 4454 - DNA, 28 bp, Artificial Sequence
  Synthetic
cagtcatttgggtcgaggagctcacagt

SEQ ID NO: 4455 - DNA, 28 bp, Artificial Sequence
  Synthetic
cagtcatttgggtagcagcacatcatgg

SEQ ID NO: 4456 - DNA, 28 bp, Artificial Sequence
  Synthetic
cagtcatttgggtagcagcacgtaaata

SEQ ID NO: 4457 - DNA, 28 bp, Artificial Sequence
  Synthetic
cagtcatttgggactgcagtgaaggcac

SEQ ID NO: 4458 - DNA, 28 bp, Artificial Sequence
  Synthetic
cagtcatttgggcaaagtgcttacagtg

SEQ ID NO: 4459 - DNA, 28 bp, Artificial Sequence
  Synthetic
cagtcatttgggaacattcaacgctgtc

SEQ ID NO: 4460 - DNA, 28 bp, Artificial Sequence
  Synthetic
cagtcatttgggaacattcattgctgtc

SEQ ID NO: 4461 - DNA, 28 bp, Artificial Sequence
  Synthetic
cagtcatttgggaacattcaacctgtcg

SEQ ID NO: 4462 - DNA, 28 bp, Artificial Sequence
  Synthetic
cagtcatttgggcaaagaattctccttt

SEQ ID NO: 4463 - DNA, 28 bp, Artificial Sequence
  Synthetic
cagtcatttgggtaaggtgcatctagtg

SEQ ID NO: 4464 - DNA, 28 bp, Artificial Sequence
  Synthetic
cagtcatttgggtaaggtgcatctagtg

SEQ ID NO: 4465 - DNA, 28 bp, Artificial Sequence
  Synthetic
cagtcatttgggcaacggaatcccaaaa

SEQ ID NO: 4466 - DNA, 28 bp, Artificial Sequence
  Synthetic
cagtcatttgggctgacctatgaattga

SEQ ID NO: 4467 - DNA, 28 bp, Artificial Sequence
  Synthetic
cagtcatttgggaactggcctacaaagt

SEQ ID NO: 4468 - DNA, 28 bp, Artificial Sequence
  Synthetic
cagtcatttgggtgggtctttgcgggcg

SEQ ID NO: 4469 - DNA, 28 bp, Artificial Sequence
  Synthetic
cagtcatttgggcccagtgttcagacta

SEQ ID NO: 4470 - DNA, 28 bp, Artificial Sequence
  Synthetic
cagtcatttgggacagtagtctgcacat

SEQ ID NO: 4471 - DNA, 28 bp, Artificial Sequence
  Synthetic
cagtcatttgggcccagtgtttagacta

SEQ ID NO: 4472 - DNA, 28 bp, Artificial Sequence
  Synthetic
cagtcatttgggtaacactgtctggtaa

SEQ ID NO: 4473 - DNA, 28 bp, Artificial Sequence
  Synthetic
cagtcatttgggtaatactgcctggtaa

SEQ ID NO: 4474 - DNA, 28 bp, Artificial Sequence
  Synthetic
cagtcatttgggtaatactgccgggtaa

SEQ ID NO: 4475 - DNA, 28 bp, Artificial Sequence
  Synthetic
cagtcatttgggtccttcattccaccgg

SEQ ID NO: 4476 - DNA, 28 bp, Artificial Sequence
  Synthetic
cagtcatttgggtaaagtgcttatagtg

SEQ ID NO: 4477 - DNA, 28 bp, Artificial Sequence
  Synthetic
cagtcatttgggcaaagtgctcacagtg

SEQ ID NO: 4478 - DNA, 28 bp, Artificial Sequence
  Synthetic
cagtcatttgggtagcttatcagactga

SEQ ID NO: 4479 - DNA, 28 bp, Artificial Sequence
  Synthetic
cagtcatttgggaacagcagtcgatggg

SEQ ID NO: 4480 - DNA, 28 bp, Artificial Sequence
  Synthetic
cagtcatttgggactgtgcgtgtgacag

SEQ ID NO: 4481 - DNA, 28 bp, Artificial Sequence
  Synthetic
cagtcatttggggtacagcaggcacaga

SEQ ID NO: 4482 - DNA, 28 bp, Artificial Sequence
  Synthetic
cagtcatttgggatgacctatgaattga

SEQ ID NO: 4483 - DNA, 28 bp, Artificial Sequence
  Synthetic
cagtcatttgggttgtgcttgatctaac

SEQ ID NO: 4484 - DNA, 28 bp, Artificial Sequence
  Synthetic
cagtcatttgggagttcttcagtggcaa

SEQ ID NO: 4485 - DNA, 28 bp, Artificial Sequence
  Synthetic
cagtcatttgggagctacattgtctgct

SEQ ID NO: 4486 - DNA, 28 bp, Artificial Sequence
  Synthetic
cagtcatttgggagctacatctggctac

SEQ ID NO: 4487 - DNA, 28 bp, Artificial Sequence
  Synthetic
cagtcatttgggatcacattgccaggga

SEQ ID NO: 4488 - DNA, 28 bp, Artificial Sequence
  Synthetic
cagtcatttgggatcacattgccaggga

SEQ ID NO: 4489 - DNA, 28 bp, Artificial Sequence
  Synthetic
cagtcatttgggtggctcagttcagcag

SEQ ID NO: 4490 - DNA, 28 bp, Artificial Sequence
  Synthetic
cagtcatttgggcattgcacttgtctcg

SEQ ID NO: 4491 - DNA, 28 bp, Artificial Sequence
  Synthetic
cagtcatttgggttcaagtaatccagga

SEQ ID NO: 4492 - DNA, 28 bp, Artificial Sequence
  Synthetic
cagtcatttgggttcaagtaattcagga

SEQ ID NO: 4493 - DNA, 28 bp, Artificial Sequence
  Synthetic
cagtcatttgggttcacagtggctaagt

SEQ ID NO: 4494 - DNA, 28 bp, Artificial Sequence
  Synthetic
cagtcatttgggttcacagtggctaagt

SEQ ID NO: 4495 - DNA, 28 bp, Artificial Sequence
  Synthetic
cagtcatttgggctagcaccatctgaaa

SEQ ID NO: 4496 - DNA, 28 bp, Artificial Sequence
  Synthetic
cagtcatttgggtagcaccatttgaaat

SEQ ID NO: 4497 - DNA, 28 bp, Artificial Sequence
  Synthetic
cagtcatttgggtagcaccatttgaaat

SEQ ID NO: 4498 - DNA, 28 bp, Artificial Sequence
  Synthetic
cagtcatttgggtgtaaacatcctcgac

SEQ ID NO: 4499 - DNA, 28 bp, Artificial Sequence
  Synthetic
cagtcatttgggtgtaaacatcctacac

SEQ ID NO: 4500 - DNA, 28 bp, Artificial Sequence
  Synthetic
cagtcatttgggtgtaaacatcctacac

SEQ ID NO: 4501 - DNA, 28 bp, Artificial Sequence
  Synthetic
cagtcatttgggtgtaaacatccccgac

SEQ ID NO: 4502 - DNA, 28 bp, Artificial Sequence
  Synthetic
cagtcatttgggtgtaaacatccttgac

SEQ ID NO: 4503 - DNA, 28 bp, Artificial Sequence
  Synthetic
cagtcatttgggaggcaagatgctggca

SEQ ID NO: 4504 - DNA, 28 bp, Artificial Sequence
  Synthetic
cagtcatttgggaaaagctgggttgaga

SEQ ID NO: 4505 - DNA, 28 bp, Artificial Sequence
  Synthetic
cagtcatttgggtctcacacagaaatcg

SEQ ID NO: 4506 - DNA, 28 bp, Artificial Sequence
  Synthetic
cagtcatttggggctgactcctagtcca

SEQ ID NO: 4507 - DNA, 28 bp, Artificial Sequence
  Synthetic
cagtcatttgggaggcagtgtaattagc

SEQ ID NO: 4508 - DNA, 28 bp, Artificial Sequence
  Synthetic
cagtcatttgggaggcagtgtagttagc

SEQ ID NO: 4509 - DNA, 28 bp, Artificial Sequence
  Synthetic
cagtcatttgggttatcagaatctccag

SEQ ID NO: 4510 - DNA, 28 bp, Artificial Sequence
  Synthetic
cagtcatttgggattgcacggtatccat

SEQ ID NO: 4511 - DNA, 28 bp, Artificial Sequence
  Synthetic
cagtcatttgggaataatacatggttga

SEQ ID NO: 4512 - DNA, 28 bp, Artificial Sequence
  Synthetic
cagtcatttgggatcgaccgtgttatat

SEQ ID NO: 4513 - DNA, 28 bp, Artificial Sequence
  Synthetic
cagtcatttgggtatgtaatgtggtcca

SEQ ID NO: 4514 - DNA, 28 bp, Artificial Sequence
  Synthetic
cagtcatttgggtggttgaccatagaac

SEQ ID NO: 4515 - DNA, 28 bp, Artificial Sequence
  Synthetic
cagtcatttgggaagctcggtctgaggc

SEQ ID NO: 4516 - DNA, 28 bp, Artificial Sequence
  Synthetic
cagtcatttgggatcgggaatgtcgtgt

SEQ ID NO: 4517 - DNA, 28 bp, Artificial Sequence
  Synthetic
cagtcatttgggatgacacgatcactcc

SEQ ID NO: 4518 - DNA, 28 bp, Artificial Sequence
  Synthetic
cagtcatttgggttttgcgatgtgttcc

SEQ ID NO: 4519 - DNA, 28 bp, Artificial Sequence
  Synthetic
cagtcatttgggtatgtgcctttggact

SEQ ID NO: 4520 - DNA, 28 bp, Artificial Sequence
  Synthetic
cagtcatttggggcagtccatgggcata

SEQ ID NO: 4521 - DNA, 28 bp, Artificial Sequence
  Synthetic
cagtcatttgggtcaggctcagtcccct

SEQ ID NO: 4522 - DNA, 28 bp, Artificial Sequence
  Synthetic
cagtcatttgggaatcatacagggacat

SEQ ID NO: 4523 - DNA, 28 bp, Artificial Sequence
  Synthetic
cagtcatttgggaatcgtacagggtcat

SEQ ID NO: 4524 - DNA, 28 bp, Artificial Sequence
  Synthetic
cagtcatttgggttaagacttgcagtga

SEQ ID NO: 4525 - DNA, 28 bp, Artificial Sequence
  Synthetic
cagtcatttgggcatgccttgagtgtag

SEQ ID NO: 4526 - DNA, 28 bp, Artificial Sequence
  Synthetic
cagtcatttgggtcagtaaatgtttatt

SEQ ID NO: 4527 - DNA, 28 bp, Artificial Sequence
  Synthetic
cagtcatttgggatcaacaaacatttat

SEQ ID NO: 4528 - DNA, 28 bp, Artificial Sequence
  Synthetic
cagtcatttgggtggaagactagtgatt

SEQ ID NO: 4529 - DNA, 28 bp, Artificial Sequence
  Synthetic
cagtcatttgggtattgcacttgtcccg

SEQ ID NO: 4530 - DNA, 28 bp, Artificial Sequence
  Synthetic
cagtcatttgggcaaagtgctgttcgtg

SEQ ID NO: 4531 - DNA, 28 bp, Artificial Sequence
  Synthetic
cagtcatttgggtgaggtagtaagttgt

SEQ ID NO: 4532 - DNA, 28 bp, Artificial Sequence
  Synthetic
cagtcatttgggaacccgtagatccgat

SEQ ID NO: 4533 - DNA, 28 bp, Artificial Sequence
  Synthetic
cagtcatttgggtgaggtagtaggttgt

SEQ ID NO: 4534 - DNA, 28 bp, Artificial Sequence
  Synthetic
cagtcatttgggtccctgagacctcaag

SEQ ID NO: 4535 - DNA, 28 bp, Artificial Sequence
  Synthetic
cagtcatttgggttttgtatgagacgca

SEQ ID NO: 4536 - DNA, 28 bp, Artificial Sequence
  Synthetic
cagtcatttgggtggaatgtaaagaagt

SEQ ID NO: 4537 - DNA, 28 bp, Artificial Sequence
  Synthetic
cagtcatttgggtaaggcacgcggtgaa

SEQ ID NO: 4538 - DNA, 28 bp, Artificial Sequence
  Synthetic
cagtcatttgggaatggcactgcatgaa

SEQ ID NO: 4539 - DNA, 28 bp, Artificial Sequence
  Synthetic
cagtcatttggggtattagttgtgcgac

SEQ ID NO: 4540 - DNA, 28 bp, Artificial Sequence
  Synthetic
cagtcatttgggtaagctcgtgaacaac

SEQ ID NO: 4541 - DNA, 28 bp, Artificial Sequence
  Synthetic
cagtcatttgggtaaatgcatcttaact

SEQ ID NO: 4542 - DNA, 28 bp, Artificial Sequence
  Synthetic
cagtcatttgggttgagcaatgcgcatg

SEQ ID NO: 4543 - DNA, 28 bp, Artificial Sequence
  Synthetic
cagtcatttgggttattgctcgagaata

SEQ ID NO: 4544 - DNA, 28 bp, Artificial Sequence
  Synthetic
cagtcatttgggtaatactgtcaggtaa

SEQ ID NO: 4545 - DNA, 28 bp, Artificial Sequence
  Synthetic
cagtcatttgggtttgtactacaattag

SEQ ID NO: 4546 - DNA, 28 bp, Artificial Sequence
  Synthetic
cagtcatttgggttgtactgcacaaaag

SEQ ID NO: 4547 - DNA, 28 bp, Artificial Sequence
  Synthetic
cagtcatttgggtactggcctccaaatt

SEQ ID NO: 4548 - DNA, 28 bp, Artificial Sequence
  Synthetic
cagtcatttgggtgaggtaggtgtgaga

SEQ ID NO: 4549 - DNA, 28 bp, Artificial Sequence
  Synthetic
cagtcatttgggtctttggttgtacaaa

SEQ ID NO: 4550 - DNA, 28 bp, Artificial Sequence
  Synthetic
cagtcatttgggattggtcccctccaag

SEQ ID NO: 4551 - DNA, 28 bp, Artificial Sequence
  Synthetic
cagtcatttgggttacatgtattgggta

SEQ ID NO: 4552 - DNA, 28 bp, Artificial Sequence
  Synthetic
cagtcatttgggtacacgtgctcggata

SEQ ID NO: 4553 - DNA, 28 bp, Artificial Sequence
  Synthetic
cagtcatttgggtcacaggatttttgag

SEQ ID NO: 4554 - DNA, 28 bp, Artificial Sequence
  Synthetic
cagtcatttgggtcacagtcaactgttg

SEQ ID NO: 4555 - DNA, 28 bp, Artificial Sequence
  Synthetic
cagtcatttgggttaagtagtggtgccg

SEQ ID NO: 4556 - DNA, 28 bp, Artificial Sequence
  Synthetic
cagtcatttgggtaagtagtagtgccgc

SEQ ID NO: 4557 - DNA, 28 bp, Artificial Sequence
  Synthetic
cagtcatttgggcacacctcactaacac

SEQ ID NO: 4558 - DNA, 28 bp, Artificial Sequence
  Synthetic
cagtcatttgggtgcaaatcttttgcaa

SEQ ID NO: 4559 - DNA, 28 bp, Artificial Sequence
  Synthetic
cagtcatttgggaaatctcatcctaatc

SEQ ID NO: 4560 - DNA, 28 bp, Artificial Sequence
  Synthetic
cagtcatttgggggcaagaattagaagc

SEQ ID NO: 4561 - DNA, 28 bp, Artificial Sequence
  Synthetic
cagtcatttgggaggcagtgtggttagc

SEQ ID NO: 4562 - DNA, 28 bp, Artificial Sequence
  Synthetic
cagtcatttgggtcaccgggtgaaaact

SEQ ID NO: 4563 - DNA, 28 bp, Artificial Sequence
  Synthetic
cagtcatttgggcaagtatcatgtgttg

SEQ ID NO: 4564 - DNA, 28 bp, Artificial Sequence
  Synthetic
cagtcatttgggaccttgtttgttgctg

SEQ ID NO: 4565 - DNA, 28 bp, Artificial Sequence
  Synthetic
cagtcatttgggtttgttttagcctgag

SEQ ID NO: 4566 - DNA, 28 bp, Artificial Sequence
  Synthetic
cagtcatttgggatgagcaacgcgaaca

SEQ ID NO: 4567 - DNA, 28 bp, Artificial Sequence
  Synthetic
cagtcatttgggaaaatgccagtcattg

SEQ ID NO: 4568 - DNA, 28 bp, Artificial Sequence
  Synthetic
cagtcatttgggcaattggtatccttag

SEQ ID NO: 4569 - DNA, 28 bp, Artificial Sequence
  Synthetic
cagtcatttgggtcaccgggtgaaaatt

SEQ ID NO: 4570 - DNA, 28 bp, Artificial Sequence
  Synthetic
cagtcatttgggtgaccgtaatcccgtt

SEQ ID NO: 4571 - DNA, 28 bp, Artificial Sequence
  Synthetic
cagtcatttgggtcaccgggagacaacc

SEQ ID NO: 4572 - DNA, 28 bp, Artificial Sequence
  Synthetic
cagtcatttgggtcaccgggtgaaaaac

SEQ ID NO: 4573 - DNA, 28 bp, Artificial Sequence
  Synthetic
cagtcatttgggtcaccgggtgtcaatc

SEQ ID NO: 4574 - DNA, 28 bp, Artificial Sequence
  Synthetic
cagtcatttgggtcaccgggtgaaaaac

SEQ ID NO: 4575 - DNA, 28 bp, Artificial Sequence
  Synthetic
cagtcatttgggcaccgggttaacatct

SEQ ID NO: 4576 - DNA, 28 bp, Artificial Sequence
  Synthetic
cagtcatttgggtatcacagtttacttg

SEQ ID NO: 4577 - DNA, 28 bp, Artificial Sequence
  Synthetic
cagtcatttgggtgactagagacacatt

SEQ ID NO: 4578 - DNA, 28 bp, Artificial Sequence
  Synthetic
cagtcatttgggtgactagagacacatt

SEQ ID NO: 4579 - DNA, 28 bp, Artificial Sequence
  Synthetic
cagtcatttgggtgtcatggagtcgctc

SEQ ID NO: 4580 - DNA, 28 bp, Artificial Sequence
  Synthetic
cagtcatttgggtgtcatggaggcgctc

SEQ ID NO: 4581 - DNA, 28 bp, Artificial Sequence
  Synthetic
cagtcatttgggtgaggtaggctcagta

SEQ ID NO: 4582 - DNA, 28 bp, Artificial Sequence
  Synthetic
cagtcatttgggaagcaccacgagaagc

SEQ ID NO: 4583 - DNA, 28 bp, Artificial Sequence
  Synthetic
cagtcatttgggtgatatgtctgatatt

SEQ ID NO: 4584 - DNA, 28 bp, Artificial Sequence
  Synthetic
cagtcatttgggtacccgtagctccttg

SEQ ID NO: 4585 - DNA, 28 bp, Artificial Sequence
  Synthetic
cagtcatttgggcacccgtacatatgtt

SEQ ID NO: 4586 - DNA, 28 bp, Artificial Sequence
  Synthetic
cagtcatttgggtacccgtatatttttc

SEQ ID NO: 4587 - DNA, 28 bp, Artificial Sequence
  Synthetic
cagtcatttgggtaccctgtagatcgag

SEQ ID NO: 4588 - DNA, 28 bp, Artificial Sequence
  Synthetic
cagtcatttgggtgagatcgttcagtac

SEQ ID NO: 4589 - DNA, 28 bp, Artificial Sequence
  Synthetic
cagtcatttgggtattatgcacattttc

SEQ ID NO: 4590 - DNA, 28 bp, Artificial Sequence
  Synthetic
cagtcatttgggtgactagaaccttgac

SEQ ID NO: 4591 - DNA, 28 bp, Artificial Sequence
  Synthetic
cagtcatttgggtgatatgtaatctagc

SEQ ID NO: 4592 - DNA, 28 bp, Artificial Sequence
  Synthetic
cagtcatttgggcatgacactgaagcgt

SEQ ID NO: 4593 - DNA, 28 bp, Artificial Sequence
  Synthetic
cagtcatttgggtcacaacctcctagaa

SEQ ID NO: 4594 - DNA, 28 bp, Artificial Sequence
  Synthetic
cagtcatttgggtaatacgtgattggtg

SEQ ID NO: 4595 - DNA, 28 bp, Artificial Sequence
  Synthetic
cagtcatttgggtgaaagacatgggtag

SEQ ID NO: 4596 - DNA, 28 bp, Artificial Sequence
  Synthetic
cagtcatttgggaggcagatgttggcat

SEQ ID NO: 4597 - DNA, 28 bp, Artificial Sequence
  Synthetic
cagtcatttgggtggcaagatgttggca

SEQ ID NO: 4598 - DNA, 28 bp, Artificial Sequence
  Synthetic
cagtcatttgggtggcaagaaatggcag

SEQ ID NO: 4599 - DNA, 28 bp, Artificial Sequence
  Synthetic
cagtcatttgggttaaagctaccaaccg

SEQ ID NO: 4600 - DNA, 28 bp, Artificial Sequence
  Synthetic
cagtcatttgggttcatcaggccatagc

SEQ ID NO: 4601 - DNA, 28 bp, Artificial Sequence
  Synthetic
cagtcatttgggataaagctaggttacc

SEQ ID NO: 4602 - DNA, 28 bp, Artificial Sequence
  Synthetic
cagtcatttgggtgagatcattagttga

SEQ ID NO: 4603 - DNA, 28 bp, Artificial Sequence
  Synthetic
cagtcatttgggtgagatcatcgtgaaa

SEQ ID NO: 4604 - DNA, 28 bp, Artificial Sequence
  Synthetic
cagtcatttgggtgagatcatcgtgaaa

SEQ ID NO: 4605 - DNA, 28 bp, Artificial Sequence
  Synthetic
cagtcatttgggtagcaccatataaatt

SEQ ID NO: 4606 - DNA, 28 bp, Artificial Sequence
  Synthetic
cagtcatttgggtgaggtagtttgcaat

SEQ ID NO: 4607 - DNA, 28 bp, Artificial Sequence
  Synthetic
cagtcatttgggtacaaagtatttgaaa

SEQ ID NO: 4608 - DNA, 28 bp, Artificial Sequence
  Synthetic
cagtcatttgggtaagtgaatgctttgc

SEQ ID NO: 4609 - DNA, 28 bp, Artificial Sequence
  Synthetic
cagtcatttggggtgagcaaagtttcag

SEQ ID NO: 4610 - DNA, 28 bp, Artificial Sequence
  Synthetic
cagtcatttgggtgatatgttgtttgaa

SEQ ID NO: 4611 - DNA, 28 bp, Artificial Sequence
  Synthetic
cagtcatttgggtgaggtagtaggttgt

SEQ ID NO: 4612 - DNA, 28 bp, Artificial Sequence
  Synthetic
cagtcatttgggtccctgagacctcaag

SEQ ID NO: 4613 - DNA, 28 bp, Artificial Sequence
  Synthetic
cagtcatttgggttttgtatgagacgca

SEQ ID NO: 4614 - DNA, 28 bp, Artificial Sequence
  Synthetic
cagtcatttgggtggaatgtaaagaagt

SEQ ID NO: 4615 - DNA, 28 bp, Artificial Sequence
  Synthetic
cagtcatttgggtaaggcacgcggtgaa

SEQ ID NO: 4616 - DNA, 28 bp, Artificial Sequence
  Synthetic
cagtcatttgggtatcacagccagcttt

SEQ ID NO: 4617 - DNA, 28 bp, Artificial Sequence
  Synthetic
cagtcatttgggagctttcgacatgatt

SEQ ID NO: 4618 - DNA, 28 bp, Artificial Sequence
  Synthetic
cagtcatttgggaatggcactgcatgaa

SEQ ID NO: 4619 - DNA, 28 bp, Artificial Sequence
  Synthetic
cagtcatttgggaatgacactggttatc

SEQ ID NO: 4620 - DNA, 28 bp, Artificial Sequence
  Synthetic
cagtcatttggggtattagttgtgcgac

SEQ ID NO: 4621 - DNA, 28 bp, Artificial Sequence
  Synthetic
cagtcatttgggtaagctcgtgatcaac

SEQ ID NO: 4622 - DNA, 28 bp, Artificial Sequence
  Synthetic
cagtcatttgggtaaatgcatcttaact

SEQ ID NO: 4623 - DNA, 28 bp, Artificial Sequence
  Synthetic
cagtcatttgggttgagcaatgcgcatg

SEQ ID NO: 4624 - DNA, 28 bp, Artificial Sequence
  Synthetic
cagtcatttgggttattgctcgagaata

SEQ ID NO: 4625 - DNA, 28 bp, Artificial Sequence
  Synthetic
cagtcatttgggtattgcactctccccg

SEQ ID NO: 4626 - DNA, 28 bp, Artificial Sequence
  Synthetic
cagtcatttgggtaatactgtcaggtaa

SEQ ID NO: 4627 - DNA, 28 bp, Artificial Sequence
  Synthetic
cagtcatttgggtccctgagaattctcg

SEQ ID NO: 4628 - DNA, 28 bp, Artificial Sequence
  Synthetic
cagtcatttgggtttgtactccgatgcc

SEQ ID NO: 4629 - DNA, 28 bp, Artificial Sequence
  Synthetic
cagtcatttgggtttgtactacacatag

SEQ ID NO: 4630 - DNA, 28 bp, Artificial Sequence
  Synthetic
cagtcatttgggttgtactacacaaaag

SEQ ID NO: 4631 - DNA, 28 bp, Artificial Sequence
  Synthetic
cagtcatttgggtactggcccccaaatc

SEQ ID NO: 4632 - DNA, 28 bp, Artificial Sequence
  Synthetic
cagtcatttgggtgaggtaggtgcgaga

SEQ ID NO: 4633 - DNA, 28 bp, Artificial Sequence
  Synthetic
cagtcatttgggttgcgtaggcctttgc

SEQ ID NO: 4634 - DNA, 28 bp, Artificial Sequence
  Synthetic
cagtcatttgggcggtacgatcgcggcg

SEQ ID NO: 4635 - DNA, 28 bp, Artificial Sequence
  Synthetic
cagtcatttgggtctttggttgtacaaa

SEQ ID NO: 4636 - DNA, 28 bp, Artificial Sequence
  Synthetic
cagtcatttgggattggtcccctccaag

SEQ ID NO: 4637 - DNA, 28 bp, Artificial Sequence
  Synthetic
cagtcatttgggttacatgtttcgggta

SEQ ID NO: 4638 - DNA, 28 bp, Artificial Sequence
  Synthetic
cagtcatttgggtgactagagcctattc

SEQ ID NO: 4639 - DNA, 28 bp, Artificial Sequence
  Synthetic
cagtcatttgggtacacgtgcacggata

SEQ ID NO: 4640 - DNA, 28 bp, Artificial Sequence
  Synthetic
cagtcatttgggtcacaggacttttgag

SEQ ID NO: 4641 - DNA, 28 bp, Artificial Sequence
  Synthetic
cagtcatttgggtcacagtcaactgttg

SEQ ID NO: 4642 - DNA, 28 bp, Artificial Sequence
  Synthetic
cagtcatttgggttaagtagtggtgccg

SEQ ID NO: 4643 - DNA, 28 bp, Artificial Sequence
  Synthetic
cagtcatttgggtaagtagtagtgccgc

SEQ ID NO: 4644 - DNA, 28 bp, Artificial Sequence
  Synthetic
cagtcatttgggcacacctcactaacac

SEQ ID NO: 4645 - DNA, 28 bp, Artificial Sequence
  Synthetic
cagtcatttgggtgcaaatctttcgcga

SEQ ID NO: 4646 - DNA, 28 bp, Artificial Sequence
  Synthetic
cagtcatttgggtggaatgcatagaaga

SEQ ID NO: 4647 - DNA, 28 bp, Artificial Sequence
  Synthetic
cagtcatttggggagtatcaggagtacc

SEQ ID NO: 4648 - DNA, 28 bp, Artificial Sequence
  Synthetic
cagtcatttgggggttttgagaggaatc

SEQ ID NO: 4649 - DNA, 28 bp, Artificial Sequence
  Synthetic
cagtcatttgggaaatctcatcctaatc

SEQ ID NO: 4650 - DNA, 28 bp, Artificial Sequence
  Synthetic
cagtcatttggggtgatgtcgaactctt

SEQ ID NO: 4651 - DNA, 28 bp, Artificial Sequence
  Synthetic
cagtcatttgggtagctttttagttttc

SEQ ID NO: 4652 - DNA, 28 bp, Artificial Sequence
  Synthetic
cagtcatttggggtttctcgatgttttc

SEQ ID NO: 4653 - DNA, 28 bp, Artificial Sequence
  Synthetic
cagtcatttgggggcgggtggttgttgt

SEQ ID NO: 4654 - DNA, 28 bp, Artificial Sequence
  Synthetic
cagtcatttgggtgagggaggaagggtg

SEQ ID NO: 4655 - DNA, 28 bp, Artificial Sequence
  Synthetic
cagtcatttgggaggcaagactttggca

SEQ ID NO: 4656 - DNA, 28 bp, Artificial Sequence
  Synthetic
cagtcatttgggcccgtgaagtgtctgc

SEQ ID NO: 4657 - DNA, 28 bp, Artificial Sequence
  Synthetic
cagtcatttgggggcaagaattagaagc

SEQ ID NO: 4658 - DNA, 28 bp, Artificial Sequence
  Synthetic
cagtcatttgggggcaagactctggcaa

SEQ ID NO: 4659 - DNA, 28 bp, Artificial Sequence
  Synthetic
cagtcatttgggggcatgatgtagcagt

SEQ ID NO: 4660 - DNA, 28 bp, Artificial Sequence
  Synthetic
cagtcatttgggtcgccgggtgggaaag

SEQ ID NO: 4661 - DNA, 28 bp, Artificial Sequence
  Synthetic
cagtcatttgggtgtaggcatgggtgtt

SEQ ID NO: 4662 - DNA, 28 bp, Artificial Sequence
  Synthetic
cagtcatttgggtgcccgtactgtgtcg

SEQ ID NO: 4663 - DNA, 28 bp, Artificial Sequence
  Synthetic
cagtcatttgggaggcagtgtggttagc

SEQ ID NO: 4664 - DNA, 28 bp, Artificial Sequence
  Synthetic
cagtcatttgggtcaccgggtggaaact

SEQ ID NO: 4665 - DNA, 28 bp, Artificial Sequence
  Synthetic
cagtcatttgggcaattgccatgtgttg

SEQ ID NO: 4666 - DNA, 28 bp, Artificial Sequence
  Synthetic
cagtcatttgggaccttgtttgttgctg

SEQ ID NO: 4667 - DNA, 28 bp, Artificial Sequence
  Synthetic
cagtcatttgggtttgttttagcctgag

SEQ ID NO: 4668 - DNA, 28 bp, Artificial Sequence
  Synthetic
cagtcatttgggttgagcaacgcgaaca

SEQ ID NO: 4669 - DNA, 28 bp, Artificial Sequence
  Synthetic
cagtcatttgggtaaatgccagtcgttg

SEQ ID NO: 4670 - DNA, 28 bp, Artificial Sequence
  Synthetic
cagtcatttgggcaattggtatccctgt

SEQ ID NO: 4671 - DNA, 28 bp, Artificial Sequence
  Synthetic
cagtcatttgggtcactggtctttctct

SEQ ID NO: 4672 - DNA, 28 bp, Artificial Sequence
  Synthetic
cagtcatttgggtcaccgggtgaaaatt

SEQ ID NO: 4673 - DNA, 28 bp, Artificial Sequence
  Synthetic
cagtcatttgggtgaccgtaatcccgtt

SEQ ID NO: 4674 - DNA, 28 bp, Artificial Sequence
  Synthetic
cagtcatttgggtcaccgggtgaacact

SEQ ID NO: 4675 - DNA, 28 bp, Artificial Sequence
  Synthetic
cagtcatttgggtcaccgggagaaaaac

SEQ ID NO: 4676 - DNA, 28 bp, Artificial Sequence
  Synthetic
cagtcatttgggtcaccgggtgtaaatc

SEQ ID NO: 4677 - DNA, 28 bp, Artificial Sequence
  Synthetic
cagtcatttgggtatcatcgatcacgtg

SEQ ID NO: 4678 - DNA, 28 bp, Artificial Sequence
  Synthetic
cagtcatttgggtcaccgggtgtacatc

SEQ ID NO: 4679 - DNA, 28 bp, Artificial Sequence
  Synthetic
cagtcatttgggtcaccgggtgaaaaat

SEQ ID NO: 4680 - DNA, 28 bp, Artificial Sequence
  Synthetic
cagtcatttgggcaccgggttaacatct

SEQ ID NO: 4681 - DNA, 28 bp, Artificial Sequence
  Synthetic
cagtcatttgggtatcacagtttacttg

SEQ ID NO: 4682 - DNA, 28 bp, Artificial Sequence
  Synthetic
cagtcatttgggtgactagagacacatt

SEQ ID NO: 4683 - DNA, 28 bp, Artificial Sequence
  Synthetic
cagtcatttgggtgactagagacacatt

SEQ ID NO: 4684 - DNA, 28 bp, Artificial Sequence
  Synthetic
cagtcatttgggtgtcatggagtcgctc

SEQ ID NO: 4685 - DNA, 28 bp, Artificial Sequence
  Synthetic
cagtcatttgggtgtcatggaggcgctc

SEQ ID NO: 4686 - DNA, 28 bp, Artificial Sequence
  Synthetic
cagtcatttgggtgaggtaggctcagta

SEQ ID NO: 4687 - DNA, 28 bp, Artificial Sequence
  Synthetic
cagtcatttgggaagcaccacgagaagc

SEQ ID NO: 4688 - DNA, 28 bp, Artificial Sequence
  Synthetic
cagtcatttgggtgatatgtctggtatt

SEQ ID NO: 4689 - DNA, 28 bp, Artificial Sequence
  Synthetic
cagtcatttgggtacccgtagctcctat

SEQ ID NO: 4690 - DNA, 28 bp, Artificial Sequence
  Synthetic
cagtcatttgggcacccgtacatatgtt

SEQ ID NO: 4691 - DNA, 28 bp, Artificial Sequence
  Synthetic
cagtcatttgggcacccgtacatttgtt

SEQ ID NO: 4692 - DNA, 28 bp, Artificial Sequence
  Synthetic
cagtcatttgggtacccgtaatcttcat

SEQ ID NO: 4693 - DNA, 28 bp, Artificial Sequence
  Synthetic
cagtcatttgggtacccgtataagtttc

SEQ ID NO: 4694 - DNA, 28 bp, Artificial Sequence
  Synthetic
cagtcatttgggtacccgtaatgtttcc

SEQ ID NO: 4695 - DNA, 28 bp, Artificial Sequence
  Synthetic
cagtcatttgggtggcggatccattttg

SEQ ID NO: 4696 - DNA, 28 bp, Artificial Sequence
  Synthetic
cagtcatttgggtaccctgtagatcgag

SEQ ID NO: 4697 - DNA, 28 bp, Artificial Sequence
  Synthetic
cagtcatttgggtgagatcgttcagtac

SEQ ID NO: 4698 - DNA, 28 bp, Artificial Sequence
  Synthetic
cagtcatttgggtcgaatcgtttatcag

SEQ ID NO: 4699 - DNA, 28 bp, Artificial Sequence
  Synthetic
cagtcatttgggtattatgcacattttc

SEQ ID NO: 4700 - DNA, 28 bp, Artificial Sequence
  Synthetic
cagtcatttgggtgactagaaccgttac

SEQ ID NO: 4701 - DNA, 28 bp, Artificial Sequence
  Synthetic
cagtcatttgggtgatatgtaatctagc

SEQ ID NO: 4702 - DNA, 28 bp, Artificial Sequence
  Synthetic
cagtcatttgggtatgacactgaagcga

SEQ ID NO: 4703 - DNA, 28 bp, Artificial Sequence
  Synthetic
cagtcatttgggtatgacactgaagcgt

SEQ ID NO: 4704 - DNA, 28 bp, Artificial Sequence
  Synthetic
cagtcatttgggtatgacactgaagcgt

SEQ ID NO: 4705 - DNA, 28 bp, Artificial Sequence
  Synthetic
cagtcatttgggcatgacactgattagg

SEQ ID NO: 4706 - DNA, 28 bp, Artificial Sequence
  Synthetic
cagtcatttgggtcacaacctcctagaa

SEQ ID NO: 4707 - DNA, 28 bp, Artificial Sequence
  Synthetic
cagtcatttgggtaatacgtcgttggtg

SEQ ID NO: 4708 - DNA, 28 bp, Artificial Sequence
  Synthetic
cagtcatttgggtgaaagacatgggtag

SEQ ID NO: 4709 - DNA, 28 bp, Artificial Sequence
  Synthetic
cagtcatttgggaggcaagatgttggca

SEQ ID NO: 4710 - DNA, 28 bp, Artificial Sequence
  Synthetic
cagtcatttgggtggcaagatgtaggca

SEQ ID NO: 4711 - DNA, 28 bp, Artificial Sequence
  Synthetic
cagtcatttgggtggcaagaaatggcag

SEQ ID NO: 4712 - DNA, 28 bp, Artificial Sequence
  Synthetic
cagtcatttgggttaaagctaccaaccg

SEQ ID NO: 4713 - DNA, 28 bp, Artificial Sequence
  Synthetic
cagtcatttgggttcgttgttgatgaag

SEQ ID NO: 4714 - DNA, 28 bp, Artificial Sequence
  Synthetic
cagtcatttgggttcatcaggccatagc

SEQ ID NO: 4715 - DNA, 28 bp, Artificial Sequence
  Synthetic
cagtcatttgggtggaggcctggttgtt

SEQ ID NO: 4716 - DNA, 28 bp, Artificial Sequence
  Synthetic
cagtcatttgggataaagctaggttacc

SEQ ID NO: 4717 - DNA, 28 bp, Artificial Sequence
  Synthetic
cagtcatttgggtgagatcattagttga

SEQ ID NO: 4718 - DNA, 28 bp, Artificial Sequence
  Synthetic
cagtcatttgggtgagatcatcgtgaaa

SEQ ID NO: 4719 - DNA, 28 bp, Artificial Sequence
  Synthetic
cagtcatttgggtgagatcatcgtgaaa

SEQ ID NO: 4720 - DNA, 28 bp, Artificial Sequence
  Synthetic
cagtcatttgggtagcaccatataaatt

SEQ ID NO: 4721 - DNA, 28 bp, Artificial Sequence
  Synthetic
cagtcatttgggtgaggtagtatgtaat

SEQ ID NO: 4722 - DNA, 28 bp, Artificial Sequence
  Synthetic
cagtcatttgggtacaaagtatttgaaa

SEQ ID NO: 4723 - DNA, 28 bp, Artificial Sequence
  Synthetic
cagtcatttgggtaagtgaatgctttgc

SEQ ID NO: 4724 - DNA, 28 bp, Artificial Sequence
  Synthetic
cagtcatttggggtgagcaaagtttcag

SEQ ID NO: 4725 - DNA, 28 bp, Artificial Sequence
  Synthetic
cagtcatttgggtgatatgttgtttgaa

SEQ ID NO: 4726 - DNA, 28 bp, Artificial Sequence
  Synthetic
cagtcatttgggtaatgcccctaaaaat

SEQ ID NO: 4727 - DNA, 28 bp, Artificial Sequence
  Synthetic
cagtcatttgggtaatactgtctggtaa

SEQ ID NO: 4728 - DNA, 28 bp, Artificial Sequence
  Synthetic
cagtcatttgggttgcatatgtaggatg

SEQ ID NO: 4729 - DNA, 28 bp, Artificial Sequence
  Synthetic
cagtcatttgggtggcagtgtattgtta

SEQ ID NO: 4730 - DNA, 28 bp, Artificial Sequence
  Synthetic
cagtcatttgggtttttgcgatgtgttc

SEQ ID NO: 4731 - DNA, 28 bp, Artificial Sequence
  Synthetic
cagtcatttgggtgagatcattttgaaa

SEQ ID NO: 4732 - DNA, 28 bp, Artificial Sequence
  Synthetic
cagtcatttgggtgaggtagtaggttgt

SEQ ID NO: 4733 - DNA, 28 bp, Artificial Sequence
  Synthetic
cagtcatttgggtggaatgtaaagaagt

SEQ ID NO: 4734 - DNA, 28 bp, Artificial Sequence
  Synthetic
cagtcatttgggaccctgtagatccgaa

SEQ ID NO: 4735 - DNA, 28 bp, Artificial Sequence
  Synthetic
cagtcatttgggaacccgtaaatccgaa

SEQ ID NO: 4736 - DNA, 28 bp, Artificial Sequence
  Synthetic
cagtcatttgggcatcacagtctgagtt

SEQ ID NO: 4737 - DNA, 28 bp, Artificial Sequence
  Synthetic
cagtcatttgggtgagtattacatcagg

SEQ ID NO: 4738 - DNA, 28 bp, Artificial Sequence
  Synthetic
cagtcatttgggtaaggcacgcggtgaa

SEQ ID NO: 4739 - DNA, 28 bp, Artificial Sequence
  Synthetic
cagtcatttgggtccctgagaccctaac

SEQ ID NO: 4740 - DNA, 28 bp, Artificial Sequence
  Synthetic
cagtcatttgggttggtccccttcaacc

SEQ ID NO: 4741 - DNA, 28 bp, Artificial Sequence
  Synthetic
cagtcatttgggtatcacagccattttg

SEQ ID NO: 4742 - DNA, 28 bp, Artificial Sequence
  Synthetic
cagtcatttgggtatcacagccattttg

SEQ ID NO: 4743 - DNA, 28 bp, Artificial Sequence
  Synthetic
cagtcatttgggtcagtctttttctctc

SEQ ID NO: 4744 - DNA, 28 bp, Artificial Sequence
  Synthetic
cagtcatttgggtggacggagaactgat

SEQ ID NO: 4745 - DNA, 28 bp, Artificial Sequence
  Synthetic
cagtcatttgggccttatcattctctcg

SEQ ID NO: 4746 - DNA, 28 bp, Artificial Sequence
  Synthetic
cagtcatttgggttgtgcgtgtgacagc

SEQ ID NO: 4747 - DNA, 28 bp, Artificial Sequence
  Synthetic
cagtcatttgggtgattgtccaaacgca

SEQ ID NO: 4748 - DNA, 28 bp, Artificial Sequence
  Synthetic
cagtcatttggggttaatggcactggaa

SEQ ID NO: 4749 - DNA, 28 bp, Artificial Sequence
  Synthetic
cagtcatttgggcttggcactgggagaa

SEQ ID NO: 4750 - DNA, 28 bp, Artificial Sequence
  Synthetic
cagtcatttgggttttgtgaccgacact

SEQ ID NO: 4751 - DNA, 28 bp, Artificial Sequence
  Synthetic
cagtcatttgggtcaggtacctgaagta

SEQ ID NO: 4752 - DNA, 28 bp, Artificial Sequence
  Synthetic
cagtcatttgggcagcgaggtatagagt

SEQ ID NO: 4753 - DNA, 28 bp, Artificial Sequence
  Synthetic
cagtcatttgggtaggaacttcataccg

SEQ ID NO: 4754 - DNA, 28 bp, Artificial Sequence
  Synthetic
cagtcatttgggtaggaacttaataccg

SEQ ID NO: 4755 - DNA, 28 bp, Artificial Sequence
  Synthetic
cagtcatttgggtaaatgcactatctgg

SEQ ID NO: 4756 - DNA, 28 bp, Artificial Sequence
  Synthetic
cagtcatttgggtcggtgggactttcgt

SEQ ID NO: 4757 - DNA, 28 bp, Artificial Sequence
  Synthetic
cagtcatttgggtgactagatccacact

SEQ ID NO: 4758 - DNA, 28 bp, Artificial Sequence
  Synthetic
cagtcatttgggtgtatttacgttgcat

SEQ ID NO: 4759 - DNA, 28 bp, Artificial Sequence
  Synthetic
cagtcatttgggtgtcatggaattgctc

SEQ ID NO: 4760 - DNA, 28 bp, Artificial Sequence
  Synthetic
cagtcatttgggaagagagctgtccgtc

SEQ ID NO: 4761 - DNA, 28 bp, Artificial Sequence
  Synthetic
cagtcatttgggaagagagctatccgtc

SEQ ID NO: 4762 - DNA, 28 bp, Artificial Sequence
  Synthetic
cagtcatttgggaatctagcctctacta

SEQ ID NO: 4763 - DNA, 28 bp, Artificial Sequence
  Synthetic
cagtcatttgggtaaatatcagctggta

SEQ ID NO: 4764 - DNA, 28 bp, Artificial Sequence
  Synthetic
cagtcatttgggtgaagtcagcaacttg

SEQ ID NO: 4765 - DNA, 28 bp, Artificial Sequence
  Synthetic
cagtcatttgggtagcaccattcgaaat

SEQ ID NO: 4766 - DNA, 28 bp, Artificial Sequence
  Synthetic
cagtcatttgggtgactagaccgaacac

SEQ ID NO: 4767 - DNA, 28 bp, Artificial Sequence
  Synthetic
cagtcatttgggtgtgttgaaaatcgtt

SEQ ID NO: 4768 - DNA, 28 bp, Artificial Sequence
  Synthetic
cagtcatttgggtttcatgtcgatttca

SEQ ID NO: 4769 - DNA, 28 bp, Artificial Sequence
  Synthetic
cagtcatttgggtaaatatttaagtgga

SEQ ID NO: 4770 - DNA, 28 bp, Artificial Sequence
  Synthetic
cagtcatttgggtatcacagccagcttt

SEQ ID NO: 4771 - DNA, 28 bp, Artificial Sequence
  Synthetic
cagtcatttgggtatcacagccagcttt

SEQ ID NO: 4772 - DNA, 28 bp, Artificial Sequence
  Synthetic
cagtcatttgggtatcacagccagcttt

SEQ ID NO: 4773 - DNA, 28 bp, Artificial Sequence
  Synthetic
cagtcatttgggtcactgggcaaagtgt

SEQ ID NO: 4774 - DNA, 28 bp, Artificial Sequence
  Synthetic
cagtcatttgggtttaggtttcacagga

SEQ ID NO: 4775 - DNA, 28 bp, Artificial Sequence
  Synthetic
cagtcatttgggtaatctcaatttgtaa

SEQ ID NO: 4776 - DNA, 28 bp, Artificial Sequence
  Synthetic
cagtcatttgggattgtacttcatcagg

SEQ ID NO: 4777 - DNA, 28 bp, Artificial Sequence
  Synthetic
cagtcatttgggtcaggtacttagtgac

SEQ ID NO: 4778 - DNA, 28 bp, Artificial Sequence
  Synthetic
cagtcatttggggggggtcactctgtgc

SEQ ID NO: 4779 - DNA, 28 bp, Artificial Sequence
  Synthetic
cagtcatttgggtcacaacctccttgag

SEQ ID NO: 4780 - DNA, 28 bp, Artificial Sequence
  Synthetic
cagtcatttgggaatcacaggattatac

SEQ ID NO: 4781 - DNA, 28 bp, Artificial Sequence
  Synthetic
cagtcatttggggcactgggtaaagttt

SEQ ID NO: 4782 - DNA, 28 bp, Artificial Sequence
  Synthetic
cagtcatttgggtattgcacacttcccg

SEQ ID NO: 4783 - DNA, 28 bp, Artificial Sequence
  Synthetic
cagtcatttgggtattgcacattcaccg

SEQ ID NO: 4784 - DNA, 28 bp, Artificial Sequence
  Synthetic
cagtcatttgggtattgcacttgagacg

SEQ ID NO: 4785 - DNA, 28 bp, Artificial Sequence
  Synthetic
cagtcatttgggtattgcacttttcaca

SEQ ID NO: 4786 - DNA, 28 bp, Artificial Sequence
  Synthetic
cagtcatttgggtattcgagccaataag

SEQ ID NO: 4787 - DNA, 28 bp, Artificial Sequence
  Synthetic
cagtcatttgggttttgattgttgctca

SEQ ID NO: 4788 - DNA, 28 bp, Artificial Sequence
  Synthetic
cagtcatttgggtgtctttttccgctta

SEQ ID NO: 4789 - DNA, 28 bp, Artificial Sequence
  Synthetic
cagtcatttgggtgaacacagctggtgg

SEQ ID NO: 4790 - DNA, 28 bp, Artificial Sequence
  Synthetic
cagtcatttgggtcactgggctttgttt

SEQ ID NO: 4791 - DNA, 28 bp, Artificial Sequence
  Synthetic
cagtcatttgggtggcaagatgtcggca

SEQ ID NO: 4792 - DNA, 28 bp, Artificial Sequence
  Synthetic
cagtcatttgggtggcaagatgtcggaa

SEQ ID NO: 4793 - DNA, 28 bp, Artificial Sequence
  Synthetic
cagtcatttgggaggtgcattgtagtcg

SEQ ID NO: 4794 - DNA, 28 bp, Artificial Sequence
  Synthetic
cagtcatttgggtggcagtgtggttagc

SEQ ID NO: 4795 - DNA, 28 bp, Artificial Sequence
  Synthetic
cagtcatttgggataaagctagacaacc

SEQ ID NO: 4796 - DNA, 28 bp, Artificial Sequence
  Synthetic
cagtcatttgggaaaggaacgatcgttg

SEQ ID NO: 4797 - DNA, 28 bp, Artificial Sequence
  Synthetic
cagtcatttgggtatcacagtggctgtt

SEQ ID NO: 4798 - DNA, 28 bp, Artificial Sequence
  Synthetic
cagtcatttgggtggaagactagtgatt

SEQ ID NO: 4799 - DNA, 28 bp, Artificial Sequence
  Synthetic
cagtcatttgggtaaagctagattacca

SEQ ID NO: 4800 - DNA, 28 bp, Artificial Sequence
  Synthetic
cagtcatttgggtaatactgtcaggtaa

SEQ ID NO: 4801 - DNA, 28 bp, Artificial Sequence
  Synthetic
cagtcatttgggttgagcaaaatttcag

SEQ ID NO: 4802 - DNA, 28 bp, Artificial Sequence
  Synthetic
cagtcatttgggcattgcacttgtcccg

SEQ ID NO: 4803 - DNA, 28 bp, Artificial Sequence
  Synthetic
cagtcatttgggaattgcactagtcccg

SEQ ID NO: 4804 - DNA, 28 bp, Artificial Sequence
  Synthetic
cagtcatttgggtctttggttatctagc

SEQ ID NO: 4805 - DNA, 28 bp, Artificial Sequence
  Synthetic
cagtcatttgggtctttggtgattttag

SEQ ID NO: 4806 - DNA, 28 bp, Artificial Sequence
  Synthetic
cagtcatttgggtctttggtattctagc

SEQ ID NO: 4807 - DNA, 28 bp, Artificial Sequence
  Synthetic
cagtcatttgggcggtataccttcagta

SEQ ID NO: 4808 - DNA, 28 bp, Artificial Sequence
  Synthetic
cagtcatttgggacgtatactgaatgta

SEQ ID NO: 4809 - DNA, 28 bp, Artificial Sequence
  Synthetic
cagtcatttgggtgagatcattttgaaa

SEQ ID NO: 4810 - DNA, 28 bp, Artificial Sequence
  Synthetic
cagtcatttgggtgaggtagtaggttgt

SEQ ID NO: 4811 - DNA, 28 bp, Artificial Sequence
  Synthetic
cagtcatttgggtggaatgtaaagaagt

SEQ ID NO: 4812 - DNA, 28 bp, Artificial Sequence
  Synthetic
cagtcatttgggaccctgtagatccgaa

SEQ ID NO: 4813 - DNA, 28 bp, Artificial Sequence
  Synthetic
cagtcatttgggaacccgtaattccgaa

SEQ ID NO: 4814 - DNA, 28 bp, Artificial Sequence
  Synthetic
cagtcatttgggcatcacagtctgagtt

SEQ ID NO: 4815 - DNA, 28 bp, Artificial Sequence
  Synthetic
cagtcatttgggtgagtattacatcagg

SEQ ID NO: 4816 - DNA, 28 bp, Artificial Sequence
  Synthetic
cagtcatttgggtaaggcacgcggtgaa

SEQ ID NO: 4817 - DNA, 28 bp, Artificial Sequence
  Synthetic
cagtcatttgggtccctgagaccctaac

SEQ ID NO: 4818 - DNA, 28 bp, Artificial Sequence
  Synthetic
cagtcatttgggttggtccccttcaacc

SEQ ID NO: 4819 - DNA, 28 bp, Artificial Sequence
  Synthetic
cagtcatttgggtatcacagccattttg

SEQ ID NO: 4820 - DNA, 28 bp, Artificial Sequence
  Synthetic
cagtcatttgggtatcacagccattttg

SEQ ID NO: 4821 - DNA, 28 bp, Artificial Sequence
  Synthetic
cagtcatttgggtcagtctttttctctc

SEQ ID NO: 4822 - DNA, 28 bp, Artificial Sequence
  Synthetic
cagtcatttgggtggacggagaactgat

SEQ ID NO: 4823 - DNA, 28 bp, Artificial Sequence
  Synthetic
cagtcatttgggttgtgcgtgtgacagc

SEQ ID NO: 4824 - DNA, 28 bp, Artificial Sequence
  Synthetic
cagtcatttgggtgattgtccaaacgca

SEQ ID NO: 4825 - DNA, 28 bp, Artificial Sequence
  Synthetic
cagtcatttggggttaatggcactggaa

SEQ ID NO: 4826 - DNA, 28 bp, Artificial Sequence
  Synthetic
cagtcatttgggcttggcactgggagaa

SEQ ID NO: 4827 - DNA, 28 bp, Artificial Sequence
  Synthetic
cagtcatttgggttttgtgaccgacact

SEQ ID NO: 4828 - DNA, 28 bp, Artificial Sequence
  Synthetic
cagtcatttgggtcaggtacctgaagta

SEQ ID NO: 4829 - DNA, 28 bp, Artificial Sequence
  Synthetic
cagtcatttgggtaggaacttcataccg

SEQ ID NO: 4830 - DNA, 28 bp, Artificial Sequence
  Synthetic
cagtcatttgggtaggaacttaataccg

SEQ ID NO: 4831 - DNA, 28 bp, Artificial Sequence
  Synthetic
cagtcatttgggtaaatgcactatctgg

SEQ ID NO: 4832 - DNA, 28 bp, Artificial Sequence
  Synthetic
cagtcatttgggtcggtgggactttcgt

SEQ ID NO: 4833 - DNA, 28 bp, Artificial Sequence
  Synthetic
cagtcatttgggtgactagatccacact

SEQ ID NO: 4834 - DNA, 28 bp, Artificial Sequence
  Synthetic
cagtcatttgggtgtatttacgttgcat

SEQ ID NO: 4835 - DNA, 28 bp, Artificial Sequence
  Synthetic
cagtcatttgggtgtcatggaattgctc

SEQ ID NO: 4836 - DNA, 28 bp, Artificial Sequence
  Synthetic
cagtcatttgggaatctagcctctacta

SEQ ID NO: 4837 - DNA, 28 bp, Artificial Sequence
  Synthetic
cagtcatttgggtaaatatcagctggta

SEQ ID NO: 4838 - DNA, 28 bp, Artificial Sequence
  Synthetic
cagtcatttgggtgaagtcagcaacttg

SEQ ID NO: 4839 - DNA, 28 bp, Artificial Sequence
  Synthetic
cagtcatttgggtagcaccattcgaaat

SEQ ID NO: 4840 - DNA, 28 bp, Artificial Sequence
  Synthetic
cagtcatttgggtgactagaccgaacac

SEQ ID NO: 4841 - DNA, 28 bp, Artificial Sequence
  Synthetic
cagtcatttgggtgtgttgaaaatcgtt

SEQ ID NO: 4842 - DNA, 28 bp, Artificial Sequence
  Synthetic
cagtcatttgggtttcatgtcgatttca

SEQ ID NO: 4843 - DNA, 28 bp, Artificial Sequence
  Synthetic
cagtcatttgggtaaatatttaagtgga

SEQ ID NO: 4844 - DNA, 28 bp, Artificial Sequence
  Synthetic
cagtcatttgggtatcacagccagcttt

SEQ ID NO: 4845 - DNA, 28 bp, Artificial Sequence
  Synthetic
cagtcatttgggtatcacagccagcttt

SEQ ID NO: 4846 - DNA, 28 bp, Artificial Sequence
  Synthetic
cagtcatttgggtatcacagccagcttt

SEQ ID NO: 4847 - DNA, 28 bp, Artificial Sequence
  Synthetic
cagtcatttgggtcactgggcaaagtgt

SEQ ID NO: 4848 - DNA, 28 bp, Artificial Sequence
  Synthetic
cagtcatttgggtaatctcaatttgtaa

SEQ ID NO: 4849 - DNA, 28 bp, Artificial Sequence
  Synthetic
cagtcatttgggattgtacttcatcagg

SEQ ID NO: 4850 - DNA, 28 bp, Artificial Sequence
  Synthetic
cagtcatttgggtcaggtacttagtgac

SEQ ID NO: 4851 - DNA, 28 bp, Artificial Sequence
  Synthetic
cagtcatttgggtcacaacctccttgag

SEQ ID NO: 4852 - DNA, 28 bp, Artificial Sequence
  Synthetic
cagtcatttgggaatcacaggattatac

SEQ ID NO: 4853 - DNA, 28 bp, Artificial Sequence
  Synthetic
cagtcatttggggcactgggtgaagttt

SEQ ID NO: 4854 - DNA, 28 bp, Artificial Sequence
  Synthetic
cagtcatttgggtattcgagccaataag

SEQ ID NO: 4855 - DNA, 28 bp, Artificial Sequence
  Synthetic
cagtcatttgggttttgattgttgctca

SEQ ID NO: 4856 - DNA, 28 bp, Artificial Sequence
  Synthetic
cagtcatttgggtgtctttttccgctta

SEQ ID NO: 4857 - DNA, 28 bp, Artificial Sequence
  Synthetic
cagtcatttgggtgaacacagctggtgg

SEQ ID NO: 4858 - DNA, 28 bp, Artificial Sequence
  Synthetic
cagtcatttgggtcactgggctttgttt

SEQ ID NO: 4859 - DNA, 28 bp, Artificial Sequence
  Synthetic
cagtcatttgggtggcaagatgtcggca

SEQ ID NO: 4860 - DNA, 28 bp, Artificial Sequence
  Synthetic
cagtcatttgggtggcaagatgtcggaa

SEQ ID NO: 4861 - DNA, 28 bp, Artificial Sequence
  Synthetic
cagtcatttgggaggtgcattgtagtcg

SEQ ID NO: 4862 - DNA, 28 bp, Artificial Sequence
  Synthetic
cagtcatttgggtggcagtgtggttagc

SEQ ID NO: 4863 - DNA, 28 bp, Artificial Sequence
  Synthetic
cagtcatttgggataaagctagacaacc

SEQ ID NO: 4864 - DNA, 28 bp, Artificial Sequence
  Synthetic
cagtcatttgggaaaggaacgatcgttg

SEQ ID NO: 4865 - DNA, 28 bp, Artificial Sequence
  Synthetic
cagtcatttgggtatcacagtggctgtt

SEQ ID NO: 4866 - DNA, 28 bp, Artificial Sequence
  Synthetic
cagtcatttgggtggaagactagtgatt

SEQ ID NO: 4867 - DNA, 28 bp, Artificial Sequence
  Synthetic
cagtcatttgggtaaagctagattacca

SEQ ID NO: 4868 - DNA, 28 bp, Artificial Sequence
  Synthetic
cagtcatttgggtaatactgtcaggtaa

SEQ ID NO: 4869 - DNA, 28 bp, Artificial Sequence
  Synthetic
cagtcatttgggttgagcaaaatttcag

SEQ ID NO: 4870 - DNA, 28 bp, Artificial Sequence
  Synthetic
cagtcatttgggcattgcacttgtcccg

SEQ ID NO: 4871 - DNA, 28 bp, Artificial Sequence
  Synthetic
cagtcatttgggaattgcactagtcccg

SEQ ID NO: 4872 - DNA, 28 bp, Artificial Sequence
  Synthetic
cagtcatttgggtctttggttatctagc

SEQ ID NO: 4873 - DNA, 28 bp, Artificial Sequence
  Synthetic
cagtcatttgggtctttggtgattttag

SEQ ID NO: 4874 - DNA, 28 bp, Artificial Sequence
  Synthetic
cagtcatttgggtctttggtattctagc

SEQ ID NO: 4875 - DNA, 28 bp, Artificial Sequence
  Synthetic
cagtcatttgggcggtataccttcagta

SEQ ID NO: 4876 - DNA, 28 bp, Artificial Sequence
  Synthetic
cagtcatttgggacgtatactgaatgta

SEQ ID NO: 4877 - DNA, 28 bp, Artificial Sequence
  Synthetic
cagtcatttgggtgaggtagtaggttgt

SEQ ID NO: 4878 - DNA, 28 bp, Artificial Sequence
  Synthetic
cagtcatttgggtgaggtagtaggttgt

SEQ ID NO: 4879 - DNA, 28 bp, Artificial Sequence
  Synthetic
cagtcatttgggtgaggtagtaggttgt

SEQ ID NO: 4880 - DNA, 28 bp, Artificial Sequence
  Synthetic
cagtcatttgggtgaggtagttggttgt

SEQ ID NO: 4881 - DNA, 28 bp, Artificial Sequence
  Synthetic
cagtcatttgggtgaggtagtagattga

SEQ ID NO: 4882 - DNA, 28 bp, Artificial Sequence
  Synthetic
cagtcatttgggtgaggtagtagattgt

SEQ ID NO: 4883 - DNA, 28 bp, Artificial Sequence
  Synthetic
cagtcatttgggtgaggtagtagtttgt

SEQ ID NO: 4884 - DNA, 28 bp, Artificial Sequence
  Synthetic
cagtcatttgggtgaggtagtaagttgt

SEQ ID NO: 4885 - DNA, 28 bp, Artificial Sequence
  Synthetic
cagtcatttgggtgaggtagtagtttgt

SEQ ID NO: 4886 - DNA, 28 bp, Artificial Sequence
  Synthetic
cagtcatttgggtgaggtagttgtttgt

SEQ ID NO: 4887 - DNA, 28 bp, Artificial Sequence
  Synthetic
cagtcatttgggtggaatgtaaagaagt

SEQ ID NO: 4888 - DNA, 28 bp, Artificial Sequence
  Synthetic
cagtcatttgggaacccgtagatccgaa

SEQ ID NO: 4889 - DNA, 28 bp, Artificial Sequence
  Synthetic
cagtcatttgggtacagtactgtgataa

SEQ ID NO: 4890 - DNA, 28 bp, Artificial Sequence
  Synthetic
cagtcatttgggtacagtactatgataa

SEQ ID NO: 4891 - DNA, 28 bp, Artificial Sequence
  Synthetic
cagtcatttgggagcagcattgtacagg

SEQ ID NO: 4892 - DNA, 28 bp, Artificial Sequence
  Synthetic
cagtcatttgggagcagcattgtacagg

SEQ ID NO: 4893 - DNA, 28 bp, Artificial Sequence
  Synthetic
cagtcatttgggtaccctgtagatccga

SEQ ID NO: 4894 - DNA, 28 bp, Artificial Sequence
  Synthetic
cagtcatttgggcaaattcgtgtcttgg

SEQ ID NO: 4895 - DNA, 28 bp, Artificial Sequence
  Synthetic
cagtcatttgggtaccctgtagaaccga

SEQ ID NO: 4896 - DNA, 28 bp, Artificial Sequence
  Synthetic
cagtcatttgggtaccctgtagatccgg

SEQ ID NO: 4897 - DNA, 28 bp, Artificial Sequence
  Synthetic
cagtcatttgggtaccctgtagaaccga

SEQ ID NO: 4898 - DNA, 28 bp, Artificial Sequence
  Synthetic
cagtcatttgggcagattcggttttagg

SEQ ID NO: 4899 - DNA, 28 bp, Artificial Sequence
  Synthetic
cagtcatttgggtggagtgtgacaatgg

SEQ ID NO: 4900 - DNA, 28 bp, Artificial Sequence
  Synthetic
cagtcatttgggtaaggcacgcggtgaa

SEQ ID NO: 4901 - DNA, 28 bp, Artificial Sequence
  Synthetic
cagtcatttgggtccctgagacccttaa

SEQ ID NO: 4902 - DNA, 28 bp, Artificial Sequence
  Synthetic
cagtcatttgggtccctgagaccctaac

SEQ ID NO: 4903 - DNA, 28 bp, Artificial Sequence
  Synthetic
cagtcatttgggtccctgagaccctaac

SEQ ID NO: 4904 - DNA, 28 bp, Artificial Sequence
  Synthetic
cagtcatttgggtcgtaccgtgagtaat

SEQ ID NO: 4905 - DNA, 28 bp, Artificial Sequence
  Synthetic
cagtcatttgggcattattacttttggt

SEQ ID NO: 4906 - DNA, 28 bp, Artificial Sequence
  Synthetic
cagtcatttgggtcacagtgaaccggtc

SEQ ID NO: 4907 - DNA, 28 bp, Artificial Sequence
  Synthetic
cagtcatttgggctttttgcggtctggg

SEQ ID NO: 4908 - DNA, 28 bp, Artificial Sequence
  Synthetic
cagtcatttgggaagcccttaccccaaa

SEQ ID NO: 4909 - DNA, 28 bp, Artificial Sequence
  Synthetic
cagtcatttgggcagtgcaatgttaaaa

SEQ ID NO: 4910 - DNA, 28 bp, Artificial Sequence
  Synthetic
cagtcatttgggcagtgcaataatgaaa

SEQ ID NO: 4911 - DNA, 28 bp, Artificial Sequence
  Synthetic
cagtcatttgggcagtgcaatattaaaa

SEQ ID NO: 4912 - DNA, 28 bp, Artificial Sequence
  Synthetic
cagtcatttgggtaacagtctacagcca

SEQ ID NO: 4913 - DNA, 28 bp, Artificial Sequence
  Synthetic
cagtcatttgggaccgtggcattagatt

SEQ ID NO: 4914 - DNA, 28 bp, Artificial Sequence
  Synthetic
cagtcatttgggtttggtccccttcaac

SEQ ID NO: 4915 - DNA, 28 bp, Artificial Sequence
  Synthetic
cagtcatttgggagctggtaaaatggaa

SEQ ID NO: 4916 - DNA, 28 bp, Artificial Sequence
  Synthetic
cagtcatttgggtttggtccccttcaac

SEQ ID NO: 4917 - DNA, 28 bp, Artificial Sequence
  Synthetic
cagtcatttggggctggtcaaatggaac

SEQ ID NO: 4918 - DNA, 28 bp, Artificial Sequence
  Synthetic
cagtcatttgggtttggtccctttcaac

SEQ ID NO: 4919 - DNA, 28 bp, Artificial Sequence
  Synthetic
cagtcatttgggtatggctttttattcc

SEQ ID NO: 4920 - DNA, 28 bp, Artificial Sequence
  Synthetic
cagtcatttgggtatggctttttattcc

SEQ ID NO: 4921 - DNA, 28 bp, Artificial Sequence
  Synthetic
cagtcatttgggtatggctttctattcc

SEQ ID NO: 4922 - DNA, 28 bp, Artificial Sequence
  Synthetic
cagtcatttgggttattgcttaagaata

SEQ ID NO: 4923 - DNA, 28 bp, Artificial Sequence
  Synthetic
cagtcatttgggagctggtgttgtgaat

SEQ ID NO: 4924 - DNA, 28 bp, Artificial Sequence
  Synthetic
cagtcatttgggtctacagtgcatgtgt

SEQ ID NO: 4925 - DNA, 28 bp, Artificial Sequence
  Synthetic
cagtcatttgggcagtggttttacccta

SEQ ID NO: 4926 - DNA, 28 bp, Artificial Sequence
  Synthetic
cagtcatttgggtaccacagggtagaac

SEQ ID NO: 4927 - DNA, 28 bp, Artificial Sequence
  Synthetic
cagtcatttgggtaacactgtctggtaa

SEQ ID NO: 4928 - DNA, 28 bp, Artificial Sequence
  Synthetic
cagtcatttgggtgtagtgtttcctact

SEQ ID NO: 4929 - DNA, 28 bp, Artificial Sequence
  Synthetic
cagtcatttgggcataaagtagaaagca

SEQ ID NO: 4930 - DNA, 28 bp, Artificial Sequence
  Synthetic
cagtcatttgggcataaagtagacagca

SEQ ID NO: 4931 - DNA, 28 bp, Artificial Sequence
  Synthetic
cagtcatttgggtgagatgaagcactgt

SEQ ID NO: 4932 - DNA, 28 bp, Artificial Sequence
  Synthetic
cagtcatttgggtacagtatagatgatg

SEQ ID NO: 4933 - DNA, 28 bp, Artificial Sequence
  Synthetic
cagtcatttggggtccagttttcccagg

SEQ ID NO: 4934 - DNA, 28 bp, Artificial Sequence
  Synthetic
cagtcatttgggtgagaactgaattcca

SEQ ID NO: 4935 - DNA, 28 bp, Artificial Sequence
  Synthetic
cagtcatttgggtgagaactgaattcca

SEQ ID NO: 4936 - DNA, 28 bp, Artificial Sequence
  Synthetic
cagtcatttgggtcagtgcattacagaa

SEQ ID NO: 4937 - DNA, 28 bp, Artificial Sequence
  Synthetic
cagtcatttgggtctcccaatccttgta

SEQ ID NO: 4938 - DNA, 28 bp, Artificial Sequence
  Synthetic
cagtcatttgggtcagtgcatgacagaa

SEQ ID NO: 4939 - DNA, 28 bp, Artificial Sequence
  Synthetic
cagtcatttgggttgcatagtcacaaaa

SEQ ID NO: 4940 - DNA, 28 bp, Artificial Sequence
  Synthetic
cagtcatttgggttgcatagtcacaaaa

SEQ ID NO: 4941 - DNA, 28 bp, Artificial Sequence
  Synthetic
cagtcatttgggttgcatagtcacaaaa

SEQ ID NO: 4942 - DNA, 28 bp, Artificial Sequence
  Synthetic
cagtcatttgggttaatgctaatcgtga

SEQ ID NO: 4943 - DNA, 28 bp, Artificial Sequence
  Synthetic
cagtcatttgggtagcagcacagaatgg

SEQ ID NO: 4944 - DNA, 28 bp, Artificial Sequence
  Synthetic
cagtcatttgggcaggccgtactgtgct

SEQ ID NO: 4945 - DNA, 28 bp, Artificial Sequence
  Synthetic
cagtcatttgggtagcagcacatcatgg

SEQ ID NO: 4946 - DNA, 28 bp, Artificial Sequence
  Synthetic
cagtcatttgggaagcagcgcgtcatgg

SEQ ID NO: 4947 - DNA, 28 bp, Artificial Sequence
  Synthetic
cagtcatttgggtagcagcacgtaaata

SEQ ID NO: 4948 - DNA, 28 bp, Artificial Sequence
  Synthetic
cagtcatttgggtagcagcacgtaaata

SEQ ID NO: 4949 - DNA, 28 bp, Artificial Sequence
  Synthetic
cagtcatttgggtagcagcatgtaaata

SEQ ID NO: 4950 - DNA, 28 bp, Artificial Sequence
  Synthetic
cagtcatttgggcaaagtgcttacagtg

SEQ ID NO: 4951 - DNA, 28 bp, Artificial Sequence
  Synthetic
cagtcatttgggactgcagtggaggcac

SEQ ID NO: 4952 - DNA, 28 bp, Artificial Sequence
  Synthetic
cagtcatttgggaacattcaacgctgtc

SEQ ID NO: 4953 - DNA, 28 bp, Artificial Sequence
  Synthetic
cagtcatttgggaccatcgaccgttgat

SEQ ID NO: 4954 - DNA, 28 bp, Artificial Sequence
  Synthetic
cagtcatttgggaacattcattgctgtc

SEQ ID NO: 4955 - DNA, 28 bp, Artificial Sequence
  Synthetic
cagtcatttgggcacattcattgctgtc

SEQ ID NO: 4956 - DNA, 28 bp, Artificial Sequence
  Synthetic
cagtcatttgggtttggcaatggtagaa

SEQ ID NO: 4957 - DNA, 28 bp, Artificial Sequence
  Synthetic
cagtcatttgggtggttctagacttgcc

SEQ ID NO: 4958 - DNA, 28 bp, Artificial Sequence
  Synthetic
cagtcatttgggtatggcactggtagaa

SEQ ID NO: 4959 - DNA, 28 bp, Artificial Sequence
  Synthetic
cagtcatttgggtggacggagaactgat

SEQ ID NO: 4960 - DNA, 28 bp, Artificial Sequence
  Synthetic
cagtcatttgggtcgtgtcttgtgttgc

SEQ ID NO: 4961 - DNA, 28 bp, Artificial Sequence
  Synthetic
cagtcatttgggtaaggtgcatctagtg

SEQ ID NO: 4962 - DNA, 28 bp, Artificial Sequence
  Synthetic
cagtcatttgggtaaggtgcatttagtg

SEQ ID NO: 4963 - DNA, 28 bp, Artificial Sequence
  Synthetic
cagtcatttgggctgccctaagtgcccc

SEQ ID NO: 4964 - DNA, 28 bp, Artificial Sequence
  Synthetic
cagtcatttgggtaaggtgcatcttgtg

SEQ ID NO: 4965 - DNA, 28 bp, Artificial Sequence
  Synthetic
cagtcatttgggtgatatgtttgatata

SEQ ID NO: 4966 - DNA, 28 bp, Artificial Sequence
  Synthetic
cagtcatttgggtgatatgtttgatatt

SEQ ID NO: 4967 - DNA, 28 bp, Artificial Sequence
  Synthetic
cagtcatttgggatgacctatgaattga

SEQ ID NO: 4968 - DNA, 28 bp, Artificial Sequence
  Synthetic
cagtcatttgggaactggcctacaaagt

SEQ ID NO: 4969 - DNA, 28 bp, Artificial Sequence
  Synthetic
cagtcatttgggaactggcccgcaaagt

SEQ ID NO: 4970 - DNA, 28 bp, Artificial Sequence
  Synthetic
cagtcatttgggtgtaacagcaactcca

SEQ ID NO: 4971 - DNA, 28 bp, Artificial Sequence
  Synthetic
cagtcatttgggtgtaacagccgctcca

SEQ ID NO: 4972 - DNA, 28 bp, Artificial Sequence
  Synthetic
cagtcatttgggtaggtagtttcatgtt

SEQ ID NO: 4973 - DNA, 28 bp, Artificial Sequence
  Synthetic
cagtcatttgggtaggtagtttcaagtt

SEQ ID NO: 4974 - DNA, 28 bp, Artificial Sequence
  Synthetic
cagtcatttgggcccagtgttcagacta

SEQ ID NO: 4975 - DNA, 28 bp, Artificial Sequence
  Synthetic
cagtcatttgggtacagtagtctgcaca

SEQ ID NO: 4976 - DNA, 28 bp, Artificial Sequence
  Synthetic
cagtcatttgggtgtgcaaatctatgca

SEQ ID NO: 4977 - DNA, 28 bp, Artificial Sequence
  Synthetic
cagtcatttgggctagttttgcatagtt

SEQ ID NO: 4978 - DNA, 28 bp, Artificial Sequence
  Synthetic
cagtcatttgggtgtgcaaatccatgca

SEQ ID NO: 4979 - DNA, 28 bp, Artificial Sequence
  Synthetic
cagtcatttgggagttttgctggtttgc

SEQ ID NO: 4980 - DNA, 28 bp, Artificial Sequence
  Synthetic
cagtcatttgggtgtgcaaatccatgca

SEQ ID NO: 4981 - DNA, 28 bp, Artificial Sequence
  Synthetic
cagtcatttgggtgtgcaaacccatgca

SEQ ID NO: 4982 - DNA, 28 bp, Artificial Sequence
  Synthetic
cagtcatttgggtaacactgtctggtaa

SEQ ID NO: 4983 - DNA, 28 bp, Artificial Sequence
  Synthetic
cagtcatttgggtaatactgcctggtaa

SEQ ID NO: 4984 - DNA, 28 bp, Artificial Sequence
  Synthetic
cagtcatttgggtaatactgcctggtaa

SEQ ID NO: 4985 - DNA, 28 bp, Artificial Sequence
  Synthetic
cagtcatttgggagaggcatagggcatg

SEQ ID NO: 4986 - DNA, 28 bp, Artificial Sequence
  Synthetic
cagtcatttgggttcctatgcatatacc

SEQ ID NO: 4987 - DNA, 28 bp, Artificial Sequence
  Synthetic
cagtcatttggggtgaaatgtttaggac

SEQ ID NO: 4988 - DNA, 28 bp, Artificial Sequence
  Synthetic
cagtcatttggggtgaaatgttcaggac

SEQ ID NO: 4989 - DNA, 28 bp, Artificial Sequence
  Synthetic
cagtcatttgggagtggttctcaacagt

SEQ ID NO: 4990 - DNA, 28 bp, Artificial Sequence
  Synthetic
cagtcatttgggttccctttgtcatcct

SEQ ID NO: 4991 - DNA, 28 bp, Artificial Sequence
  Synthetic
cagtcatttgggtccttcattccaccgg

SEQ ID NO: 4992 - DNA, 28 bp, Artificial Sequence
  Synthetic
cagtcatttgggtggaatgtaaggaagt

SEQ ID NO: 4993 - DNA, 28 bp, Artificial Sequence
  Synthetic
cagtcatttgggtaaagtgcttatagtg

SEQ ID NO: 4994 - DNA, 28 bp, Artificial Sequence
  Synthetic
cagtcatttgggactgcagtgtgagcac

SEQ ID NO: 4995 - DNA, 28 bp, Artificial Sequence
  Synthetic
cagtcatttgggcaaagtgctcacagtg

SEQ ID NO: 4996 - DNA, 28 bp, Artificial Sequence
  Synthetic
cagtcatttgggtagcttatcagactgg

SEQ ID NO: 4997 - DNA, 28 bp, Artificial Sequence
  Synthetic
cagtcatttgggctgtgcgtgtgacagc

SEQ ID NO: 4998 - DNA, 28 bp, Artificial Sequence
  Synthetic
cagtcatttgggagccactgactaacgc

SEQ ID NO: 4999 - DNA, 28 bp, Artificial Sequence
  Synthetic
cagtcatttgggtaacagtctacagtca

SEQ ID NO: 5000 - DNA, 28 bp, Artificial Sequence
  Synthetic
cagtcatttgggacagcaggcacagaca

SEQ ID NO: 5001 - DNA, 28 bp, Artificial Sequence
  Synthetic
cagtcatttgggtaatctcagctggcaa

SEQ ID NO: 5002 - DNA, 28 bp, Artificial Sequence
  Synthetic
cagtcatttgggtaatctctgcaggcaa

SEQ ID NO: 5003 - DNA, 28 bp, Artificial Sequence
  Synthetic
cagtcatttgggtactgcatcaggaact

SEQ ID NO: 5004 - DNA, 28 bp, Artificial Sequence
  Synthetic
cagtcatttgggttgtgcttgatctaac

SEQ ID NO: 5005 - DNA, 28 bp, Artificial Sequence
  Synthetic
cagtcatttgggttgtgcttgatctaac

SEQ ID NO: 5006 - DNA, 28 bp, Artificial Sequence
  Synthetic
cagtcatttgggtgattgtccaaacgca

SEQ ID NO: 5007 - DNA, 28 bp, Artificial Sequence
  Synthetic
cagtcatttgggccacaaccgtatcgga

SEQ ID NO: 5008 - DNA, 28 bp, Artificial Sequence
  Synthetic
cagtcatttgggagctacattgtctgct

SEQ ID NO: 5009 - DNA, 28 bp, Artificial Sequence
  Synthetic
cagtcatttgggagctacatctggctac

SEQ ID NO: 5010 - DNA, 28 bp, Artificial Sequence
  Synthetic
cagtcatttgggtgtcagtttgtcaaat

SEQ ID NO: 5011 - DNA, 28 bp, Artificial Sequence
  Synthetic
cagtcatttgggaagctgccagctgaag

SEQ ID NO: 5012 - DNA, 28 bp, Artificial Sequence
  Synthetic
cagtcatttgggaagctgccagttgaag

SEQ ID NO: 5013 - DNA, 28 bp, Artificial Sequence
  Synthetic
cagtcatttgggatcacattgccaggga

SEQ ID NO: 5014 - DNA, 28 bp, Artificial Sequence
  Synthetic
cagtcatttgggatcacattgccaggga

SEQ ID NO: 5015 - DNA, 28 bp, Artificial Sequence
  Synthetic
cagtcatttgggtggctcagttcagcag

SEQ ID NO: 5016 - DNA, 28 bp, Artificial Sequence
  Synthetic
cagtcatttgggcattgcacttgtctcg

SEQ ID NO: 5017 - DNA, 28 bp, Artificial Sequence
  Synthetic
cagtcatttgggttcaagtaatccagga

SEQ ID NO: 5018 - DNA, 28 bp, Artificial Sequence
  Synthetic
cagtcatttgggttcaagtaatccagga

SEQ ID NO: 5019 - DNA, 28 bp, Artificial Sequence
  Synthetic
cagtcatttgggttcacagtggctaagt

SEQ ID NO: 5020 - DNA, 28 bp, Artificial Sequence
  Synthetic
cagtcatttgggttcacagtggctaagt

SEQ ID NO: 5021 - DNA, 28 bp, Artificial Sequence
  Synthetic
cagtcatttgggttcacagtggttaagt

SEQ ID NO: 5022 - DNA, 28 bp, Artificial Sequence
  Synthetic
cagtcatttgggcttaacccacttgtga

SEQ ID NO: 5023 - DNA, 28 bp, Artificial Sequence
  Synthetic
cagtcatttgggttcacagtggctaagt

SEQ ID NO: 5024 - DNA, 28 bp, Artificial Sequence
  Synthetic
cagtcatttgggttcacagtggctaagt

SEQ ID NO: 5025 - DNA, 28 bp, Artificial Sequence
  Synthetic
cagtcatttgggtagcaccatttgaaat

SEQ ID NO: 5026 - DNA, 28 bp, Artificial Sequence
  Synthetic
cagtcatttgggtagcaccatttgaaat

SEQ ID NO: 5027 - DNA, 28 bp, Artificial Sequence
  Synthetic
cagtcatttgggcagtgcaatagtattg

SEQ ID NO: 5028 - DNA, 28 bp, Artificial Sequence
  Synthetic
cagtcatttgggcagtgcaatagtattg

SEQ ID NO: 5029 - DNA, 28 bp, Artificial Sequence
  Synthetic
cagtcatttgggcagtgcaatagtattg

SEQ ID NO: 5030 - DNA, 28 bp, Artificial Sequence
  Synthetic
cagtcatttgggtgtaaacattcccgac

SEQ ID NO: 5031 - DNA, 28 bp, Artificial Sequence
  Synthetic
cagtcatttgggtgtaaacatcctacac

SEQ ID NO: 5032 - DNA, 28 bp, Artificial Sequence
  Synthetic
cagtcatttgggtgtaaacatcctacac

SEQ ID NO: 5033 - DNA, 28 bp, Artificial Sequence
  Synthetic
cagtcatttgggtgtaaacatccccgac

SEQ ID NO: 5034 - DNA, 28 bp, Artificial Sequence
  Synthetic
cagtcatttgggtgtaaacatccttgac

SEQ ID NO: 5035 - DNA, 28 bp, Artificial Sequence
  Synthetic
cagtcatttgggctttcagtcggatgtt

SEQ ID NO: 5036 - DNA, 28 bp, Artificial Sequence
  Synthetic
cagtcatttgggggcaagatgttggcat

SEQ ID NO: 5037 - DNA, 28 bp, Artificial Sequence
  Synthetic
cagtcatttgggtccagcatcagtgatt

SEQ ID NO: 5038 - DNA, 28 bp, Artificial Sequence
  Synthetic
cagtcatttgggtggcagtgtcttagct

SEQ ID NO: 5039 - DNA, 28 bp, Artificial Sequence
  Synthetic
cagtcatttgggtaggcagtgttgttag

SEQ ID NO: 5040 - DNA, 28 bp, Artificial Sequence
  Synthetic
cagtcatttgggaggcagtgcagttagt

SEQ ID NO: 5041 - DNA, 28 bp, Artificial Sequence
  Synthetic
cagtcatttgggaattgcacggtatcca

SEQ ID NO: 5042 - DNA, 28 bp, Artificial Sequence
  Synthetic
cagtcatttgggtaatgcccctaaaaat

SEQ ID NO: 5043 - DNA, 28 bp, Artificial Sequence
  Synthetic
cagtcatttgggtttgttcgttcggctc

SEQ ID NO: 5044 - DNA, 28 bp, Artificial Sequence
  Synthetic
cagtcatttgggtaatactgtctggtaa

SEQ ID NO: 5045 - DNA, 28 bp, Artificial Sequence
  Synthetic
cagtcatttgggtaagtgctatttgttg

SEQ ID NO: 5046 - DNA, 28 bp, Artificial Sequence
  Synthetic
cagtcatttgggaaagtgctatcaagtt

SEQ ID NO: 5047 - DNA, 28 bp, Artificial Sequence
  Synthetic
cagtcatttgggtaagtgcttctctttg

SEQ ID NO: 5048 - DNA, 28 bp, Artificial Sequence
  Synthetic
cagtcatttgggtaagtgctatttgttg

SEQ ID NO: 5049 - DNA, 28 bp, Artificial Sequence
  Synthetic
cagtcatttgggaaagtgctatcaaatt

SEQ ID NO: 5050 - DNA, 28 bp, Artificial Sequence
  Synthetic
cagtcatttgggaaaccgttaccattac

SEQ ID NO: 5051 - DNA, 28 bp, Artificial Sequence
  Synthetic
cagtcatttgggtagtgcaatattgcta

SEQ ID NO: 5052 - DNA, 28 bp, Artificial Sequence
  Synthetic
cagtcatttgggtagtgcaatattgctt

SEQ ID NO: 5053 - DNA, 28 bp, Artificial Sequence
  Synthetic
cagtcatttgggtatgtgcccttggact

SEQ ID NO: 5054 - DNA, 28 bp, Artificial Sequence
  Synthetic
cagtcatttgggcaggctggttagatgg

SEQ ID NO: 5055 - DNA, 28 bp, Artificial Sequence
  Synthetic
cagtcatttgggaagcagcacatcaata

SEQ ID NO: 5056 - DNA, 28 bp, Artificial Sequence
  Synthetic
cagtcatttgggaagcagcacataaata

SEQ ID NO: 5057 - DNA, 28 bp, Artificial Sequence
  Synthetic
cagtcatttgggatagctctttgaatgg

SEQ ID NO: 5058 - DNA, 28 bp, Artificial Sequence
  Synthetic
cagtcatttgggtcagtaacaaggattc

SEQ ID NO: 5059 - DNA, 28 bp, Artificial Sequence
  Synthetic
cagtcatttgggcagggaatctctgtta

SEQ ID NO: 5060 - DNA, 28 bp, Artificial Sequence
  Synthetic
cagtcatttgggcacagcgcatacaatg

SEQ ID NO: 5061 - DNA, 28 bp, Artificial Sequence
  Synthetic
cagtcatttgggcctgcattgtacacac

SEQ ID NO: 5062 - DNA, 28 bp, Artificial Sequence
  Synthetic
cagtcatttgggtcaggaatgggctaaa

SEQ ID NO: 5063 - DNA, 28 bp, Artificial Sequence
  Synthetic
cagtcatttgggtaacggaacccataat

SEQ ID NO: 5064 - DNA, 28 bp, Artificial Sequence
  Synthetic
cagtcatttgggagtgacatcatatgta

SEQ ID NO: 5065 - DNA, 28 bp, Artificial Sequence
  Synthetic
cagtcatttgggttaagacttgcagtga

SEQ ID NO: 5066 - DNA, 28 bp, Artificial Sequence
  Synthetic
cagtcatttgggttttttgcagaaacgt

SEQ ID NO: 5067 - DNA, 28 bp, Artificial Sequence
  Synthetic
cagtcatttgggaagacatcaattaaat

SEQ ID NO: 5068 - DNA, 28 bp, Artificial Sequence
  Synthetic
cagtcatttggggacagttttaaatgat

SEQ ID NO: 5069 - DNA, 28 bp, Artificial Sequence
  Synthetic
cagtcatttgggttaaagggaatttgcg

SEQ ID NO: 5070 - DNA, 28 bp, Artificial Sequence
  Synthetic
cagtcatttgggttcagtcattgtttct

SEQ ID NO: 5071 - DNA, 28 bp, Artificial Sequence
  Synthetic
cagtcatttgggttcactactagcagaa

SEQ ID NO: 5072 - DNA, 28 bp, Artificial Sequence
  Synthetic
cagtcatttggggttgaggcgagttgaa

SEQ ID NO: 5073 - DNA, 28 bp, Artificial Sequence
  Synthetic
cagtcatttgggtcagtcttcaattcct

SEQ ID NO: 5074 - DNA, 28 bp, Artificial Sequence
  Synthetic
cagtcatttgggatactaagtacactac

SEQ ID NO: 5075 - DNA, 28 bp, Artificial Sequence
  Synthetic
cagtcatttgggcatgggtatgatacga

SEQ ID NO: 5076 - DNA, 28 bp, Artificial Sequence
  Synthetic
cagtcatttgggtcctcattgtgcatgc

SEQ ID NO: 5077 - DNA, 28 bp, Artificial Sequence
  Synthetic
cagtcatttgggaatgacacgttttctc

SEQ ID NO: 5078 - DNA, 28 bp, Artificial Sequence
  Synthetic
cagtcatttgggctcaaagcagagaact

SEQ ID NO: 5079 - DNA, 28 bp, Artificial Sequence
  Synthetic
cagtcatttgggtgcgttggtttagctc

SEQ ID NO: 5080 - DNA, 28 bp, Artificial Sequence
  Synthetic
cagtcatttggggtaaatgctgcagaat

SEQ ID NO: 5081 - DNA, 28 bp, Artificial Sequence
  Synthetic
cagtcatttgggctctcccaccgctaaa

SEQ ID NO: 5082 - DNA, 28 bp, Artificial Sequence
  Synthetic
cagtcatttggggtaagacgaacaaaaa

SEQ ID NO: 5083 - DNA, 28 bp, Artificial Sequence
  Synthetic
cagtcatttgggaatcaaaacctaaaga

SEQ ID NO: 5084 - DNA, 28 bp, Artificial Sequence
  Synthetic
cagtcatttggggctacggcccgcgtcg

SEQ ID NO: 5085 - DNA, 28 bp, Artificial Sequence
  Synthetic
cagtcatttgggaggccgaagtggagaa

SEQ ID NO: 5086 - DNA, 28 bp, Artificial Sequence
  Synthetic
cagtcatttgggataaaaagtggtatgg

SEQ ID NO: 5087 - DNA, 28 bp, Artificial Sequence
  Synthetic
cagtcatttgggtggaagactagtgatt

SEQ ID NO: 5088 - DNA, 28 bp, Artificial Sequence
  Synthetic
cagtcatttgggtggaagacttgtgatt

SEQ ID NO: 5089 - DNA, 28 bp, Artificial Sequence
  Synthetic
cagtcatttgggtctttggttatctagc

SEQ ID NO: 5090 - DNA, 28 bp, Artificial Sequence
  Synthetic
cagtcatttgggtaaagctagataaccg

SEQ ID NO: 5091 - DNA, 28 bp, Artificial Sequence
  Synthetic
cagtcatttgggtattgcacttgtcccg

SEQ ID NO: 5092 - DNA, 28 bp, Artificial Sequence
  Synthetic
cagtcatttgggtattgcactcgtcccg

SEQ ID NO: 5093 - DNA, 28 bp, Artificial Sequence
  Synthetic
cagtcatttgggaaaagtgctgtttgtg

SEQ ID NO: 5094 - DNA, 28 bp, Artificial Sequence
  Synthetic
cagtcatttgggtttggcactagcacat

SEQ ID NO: 5095 - DNA, 28 bp, Artificial Sequence
  Synthetic
cagtcatttgggaacccgtagatccgat

SEQ ID NO: 5096 - DNA, 28 bp, Artificial Sequence
  Synthetic
cagtcatttgggtagcaccgctatccac

SEQ ID NO: 5097 - DNA, 28 bp, Artificial Sequence
  Synthetic
cagtcatttgggtcttagtggaagtgac

SEQ ID NO: 5098 - DNA, 28 bp, Artificial Sequence
  Synthetic
cagtcatttgggacataaccatggagtt

SEQ ID NO: 5099 - DNA, 28 bp, Artificial Sequence
  Synthetic
cagtcatttgggacgcacaccaggctga

SEQ ID NO: 5100 - DNA, 28 bp, Artificial Sequence
  Synthetic
cagtcatttggggacagtttggtgcgct

SEQ ID NO: 5101 - DNA, 28 bp, Artificial Sequence
  Synthetic
cagtcatttgggtcctgtggtgtttggt

SEQ ID NO: 5102 - DNA, 28 bp, Artificial Sequence
  Synthetic
cagtcatttgggtgtaacttgccaggga

SEQ ID NO: 5103 - DNA, 28 bp, Artificial Sequence
  Synthetic
cagtcatttgggtaaatgctgcagtagt

SEQ ID NO: 5104 - DNA, 28 bp, Artificial Sequence
  Synthetic
cagtcatttgggtaccctacgctgccga

SEQ ID NO: 5105 - DNA, 28 bp, Artificial Sequence
  Synthetic
cagtcatttgggagtggttttgtttcct

SEQ ID NO: 5106 - DNA, 28 bp, Artificial Sequence
  Synthetic
cagtcatttgggatagagtgggtgtgtg

SEQ ID NO: 5107 - DNA, 28 bp, Artificial Sequence
  Synthetic
cagtcatttgggttgtatgcctggtgtc

SEQ ID NO: 5108 - DNA, 28 bp, Artificial Sequence
  Synthetic
cagtcatttgggaagaggacgcaggcat

SEQ ID NO: 5109 - DNA, 28 bp, Artificial Sequence
  Synthetic
cagtcatttgggcaagttcgcacttcct

SEQ ID NO: 5110 - DNA, 28 bp, Artificial Sequence
  Synthetic
cagtcatttgggtgttttgtttgcttgg

SEQ ID NO: 5111 - DNA, 28 bp, Artificial Sequence
  Synthetic
cagtcatttgggtattttctgcattcgc

SEQ ID NO: 5112 - DNA, 28 bp, Artificial Sequence
  Synthetic
cagtcatttgggcatgaaggcacagcct

SEQ ID NO: 5113 - DNA, 28 bp, Artificial Sequence
  Synthetic
cagtcatttggggtagcaggcatgtctt

SEQ ID NO: 5114 - DNA, 28 bp, Artificial Sequence
  Synthetic
cagtcatttgggcgcaccactagtcacc

SEQ ID NO: 5115 - DNA, 28 bp, Artificial Sequence
  Synthetic
cagtcatttgggaacctagtgttagtgt

SEQ ID NO: 5116 - DNA, 28 bp, Artificial Sequence
  Synthetic
cagtcatttggggacctgatgctgctgg

SEQ ID NO: 5117 - DNA, 28 bp, Artificial Sequence
  Synthetic
cagtcatttgggcaaggtgaatatagct

SEQ ID NO: 5118 - DNA, 28 bp, Artificial Sequence
  Synthetic
cagtcatttgggcggggatcggactagc

SEQ ID NO: 5119 - DNA, 28 bp, Artificial Sequence
  Synthetic
cagtcatttgggggttggtccaatccat

SEQ ID NO: 5120 - DNA, 28 bp, Artificial Sequence
  Synthetic
cagtcatttgggcatcatagtccagtgt

SEQ ID NO: 5121 - DNA, 28 bp, Artificial Sequence
  Synthetic
cagtcatttggggtcacaatctatgggg

SEQ ID NO: 5122 - DNA, 28 bp, Artificial Sequence
  Synthetic
cagtcatttgggtacggtttcctagatt

SEQ ID NO: 5123 - DNA, 28 bp, Artificial Sequence
  Synthetic
cagtcatttgggtaacacttcatgggtc

SEQ ID NO: 5124 - DNA, 28 bp, Artificial Sequence
  Synthetic
cagtcatttgggtaacctgatcagcccc

SEQ ID NO: 5125 - DNA, 28 bp, Artificial Sequence
  Synthetic
cagtcatttgggtatcttttgcggcaga

SEQ ID NO: 5126 - DNA, 28 bp, Artificial Sequence
  Synthetic
cagtcatttgggaaattctgttgcagca

SEQ ID NO: 5127 - DNA, 28 bp, Artificial Sequence
  Synthetic
cagtcatttgggtaacgggaagtgtgta

SEQ ID NO: 5128 - DNA, 28 bp, Artificial Sequence
  Synthetic
cagtcatttgggtgaggtagtaggttgt

SEQ ID NO: 5129 - DNA, 28 bp, Artificial Sequence
  Synthetic
cagtcatttgggtgaggtagtaggttgt

SEQ ID NO: 5130 - DNA, 28 bp, Artificial Sequence
  Synthetic
cagtcatttgggtgaggtagttggttgt

SEQ ID NO: 5131 - DNA, 28 bp, Artificial Sequence
  Synthetic
cagtcatttgggtgaggtagtagattga

SEQ ID NO: 5132 - DNA, 28 bp, Artificial Sequence
  Synthetic
cagtcatttgggtgaggtagtagtttgt

SEQ ID NO: 5133 - DNA, 28 bp, Artificial Sequence
  Synthetic
cagtcatttgggtgaggtagtaagttgt

SEQ ID NO: 5134 - DNA, 28 bp, Artificial Sequence
  Synthetic
cagtcatttgggtgaggtagtagtttgt

SEQ ID NO: 5135 - DNA, 28 bp, Artificial Sequence
  Synthetic
cagtcatttgggtgaggtagttttttgt

SEQ ID NO: 5136 - DNA, 28 bp, Artificial Sequence
  Synthetic
cagtcatttgggtggaatgtaaagaagt

SEQ ID NO: 5137 - DNA, 28 bp, Artificial Sequence
  Synthetic
cagtcatttgggaacccgtagatccgaa

SEQ ID NO: 5138 - DNA, 28 bp, Artificial Sequence
  Synthetic
cagtcatttgggtacagtactgtgataa

SEQ ID NO: 5139 - DNA, 28 bp, Artificial Sequence
  Synthetic
cagtcatttgggtacagtactatgataa

SEQ ID NO: 5140 - DNA, 28 bp, Artificial Sequence
  Synthetic
cagtcatttgggagcagcattgtacagg

SEQ ID NO: 5141 - DNA, 28 bp, Artificial Sequence
  Synthetic
cagtcatttgggagcagcattgtacagg

SEQ ID NO: 5142 - DNA, 28 bp, Artificial Sequence
  Synthetic
cagtcatttgggtaccctgtagaaccga

SEQ ID NO: 5143 - DNA, 28 bp, Artificial Sequence
  Synthetic
cagtcatttgggtaccctgtagatccgg

SEQ ID NO: 5144 - DNA, 28 bp, Artificial Sequence
  Synthetic
cagtcatttgggtaccctgtagaaccga

SEQ ID NO: 5145 - DNA, 28 bp, Artificial Sequence
  Synthetic
cagtcatttgggtggagtgtgacaatgg

SEQ ID NO: 5146 - DNA, 28 bp, Artificial Sequence
  Synthetic
cagtcatttgggtaaggcacgcggtgaa

SEQ ID NO: 5147 - DNA, 28 bp, Artificial Sequence
  Synthetic
cagtcatttgggtccctgagacccttaa

SEQ ID NO: 5148 - DNA, 28 bp, Artificial Sequence
  Synthetic
cagtcatttgggtccctgagaccctaac

SEQ ID NO: 5149 - DNA, 28 bp, Artificial Sequence
  Synthetic
cagtcatttgggtcgtaccgtgagtaat

SEQ ID NO: 5150 - DNA, 28 bp, Artificial Sequence
  Synthetic
cagtcatttgggtcacagtgaaccggtc

SEQ ID NO: 5151 - DNA, 28 bp, Artificial Sequence
  Synthetic
cagtcatttgggctttttgcggtctggg

SEQ ID NO: 5152 - DNA, 28 bp, Artificial Sequence
  Synthetic
cagtcatttgggcagtgcaatattaaaa

SEQ ID NO: 5153 - DNA, 28 bp, Artificial Sequence
  Synthetic
cagtcatttgggtaacagtctacagcca

SEQ ID NO: 5154 - DNA, 28 bp, Artificial Sequence
  Synthetic
cagtcatttgggtttggtccccttcaac

SEQ ID NO: 5155 - DNA, 28 bp, Artificial Sequence
  Synthetic
cagtcatttgggtatggctttctattcc

SEQ ID NO: 5156 - DNA, 28 bp, Artificial Sequence
  Synthetic
cagtcatttgggtatggctttttattcc

SEQ ID NO: 5157 - DNA, 28 bp, Artificial Sequence
  Synthetic
cagtcatttgggttattgcttaagaata

SEQ ID NO: 5158 - DNA, 28 bp, Artificial Sequence
  Synthetic
cagtcatttgggagctggtgttgtgaat

SEQ ID NO: 5159 - DNA, 28 bp, Artificial Sequence
  Synthetic
cagtcatttgggcagtggttttacccta

SEQ ID NO: 5160 - DNA, 28 bp, Artificial Sequence
  Synthetic
cagtcatttgggcataaagtagaaagca

SEQ ID NO: 5161 - DNA, 28 bp, Artificial Sequence
  Synthetic
cagtcatttgggcataaagtagaaagca

SEQ ID NO: 5162 - DNA, 28 bp, Artificial Sequence
  Synthetic
cagtcatttgggtacagtatagatgatg

SEQ ID NO: 5163 - DNA, 28 bp, Artificial Sequence
  Synthetic
cagtcatttgggtcagtgcattacagaa

SEQ ID NO: 5164 - DNA, 28 bp, Artificial Sequence
  Synthetic
cagtcatttgggtcagtgcataacagaa

SEQ ID NO: 5165 - DNA, 28 bp, Artificial Sequence
  Synthetic
cagtcatttgggttgcatagtcacaaaa

SEQ ID NO: 5166 - DNA, 28 bp, Artificial Sequence
  Synthetic
cagtcatttgggttgcatagtcacaaaa

SEQ ID NO: 5167 - DNA, 28 bp, Artificial Sequence
  Synthetic
cagtcatttgggtagcagcacggaatgg

SEQ ID NO: 5168 - DNA, 28 bp, Artificial Sequence
  Synthetic
cagtcatttgggtagcagcgcatcatgg

SEQ ID NO: 5169 - DNA, 28 bp, Artificial Sequence
  Synthetic
cagtcatttgggtagcagcacgtaaata

SEQ ID NO: 5170 - DNA, 28 bp, Artificial Sequence
  Synthetic
cagtcatttgggcaaagtgcttacagtg

SEQ ID NO: 5171 - DNA, 28 bp, Artificial Sequence
  Synthetic
cagtcatttgggtaaggtgcatctagtg

SEQ ID NO: 5172 - DNA, 28 bp, Artificial Sequence
  Synthetic
cagtcatttgggaacattcaacgctgtc

SEQ ID NO: 5173 - DNA, 28 bp, Artificial Sequence
  Synthetic
cagtcatttgggaccatcgaccgttgat

SEQ ID NO: 5174 - DNA, 28 bp, Artificial Sequence
  Synthetic
cagtcatttgggaacattcattgctgtc

SEQ ID NO: 5175 - DNA, 28 bp, Artificial Sequence
  Synthetic
cagtcatttgggtggttctagacttgcc

SEQ ID NO: 5176 - DNA, 28 bp, Artificial Sequence
  Synthetic
cagtcatttgggtatggcactggtagaa

SEQ ID NO: 5177 - DNA, 28 bp, Artificial Sequence
  Synthetic
cagtcatttgggtggacggagaactgat

SEQ ID NO: 5178 - DNA, 28 bp, Artificial Sequence
  Synthetic
cagtcatttgggtcgtgtcttgtgttgc

SEQ ID NO: 5179 - DNA, 28 bp, Artificial Sequence
  Synthetic
cagtcatttggggtgcctactgaactgg

SEQ ID NO: 5180 - DNA, 28 bp, Artificial Sequence
  Synthetic
cagtcatttgggtgatatgtttgatata

SEQ ID NO: 5181 - DNA, 28 bp, Artificial Sequence
  Synthetic
cagtcatttgggatgacctatgaattga

SEQ ID NO: 5182 - DNA, 28 bp, Artificial Sequence
  Synthetic
cagtcatttgggaactggcctacaaagt

SEQ ID NO: 5183 - DNA, 28 bp, Artificial Sequence
  Synthetic
cagtcatttgggtgtaacagcaactcca

SEQ ID NO: 5184 - DNA, 28 bp, Artificial Sequence
  Synthetic
cagtcatttgggtaggtagtttcatgtt

SEQ ID NO: 5185 - DNA, 28 bp, Artificial Sequence
  Synthetic
cagtcatttgggtaggtagtttcaagtt

SEQ ID NO: 5186 - DNA, 28 bp, Artificial Sequence
  Synthetic
cagtcatttgggcccagtgttcagacta

SEQ ID NO: 5187 - DNA, 28 bp, Artificial Sequence
  Synthetic
cagtcatttgggtgtgcaaatctatgca

SEQ ID NO: 5188 - DNA, 28 bp, Artificial Sequence
  Synthetic
cagtcatttgggtgtgcaaatccatgca

SEQ ID NO: 5189 - DNA, 28 bp, Artificial Sequence
  Synthetic
cagtcatttgggtaaagtgcttatagtg

SEQ ID NO: 5190 - DNA, 28 bp, Artificial Sequence
  Synthetic
cagtcatttgggtaacactgtctggtaa

SEQ ID NO: 5191 - DNA, 28 bp, Artificial Sequence
  Synthetic
cagtcatttgggtaatactgcctggtaa

SEQ ID NO: 5192 - DNA, 28 bp, Artificial Sequence
  Synthetic
cagtcatttgggagaggcatagggcatg

SEQ ID NO: 5193 - DNA, 28 bp, Artificial Sequence
  Synthetic
cagtcatttggggtgaaatgtttaggac

SEQ ID NO: 5194 - DNA, 28 bp, Artificial Sequence
  Synthetic
cagtcatttgggttccctttgtcatcct

SEQ ID NO: 5195 - DNA, 28 bp, Artificial Sequence
  Synthetic
cagtcatttgggtccttcattccaccgg

SEQ ID NO: 5196 - DNA, 28 bp, Artificial Sequence
  Synthetic
cagtcatttgggtagcttatcagactgg

SEQ ID NO: 5197 - DNA, 28 bp, Artificial Sequence
  Synthetic
cagtcatttgggctgtgcgtgtgacagc

SEQ ID NO: 5198 - DNA, 28 bp, Artificial Sequence
  Synthetic
cagtcatttgggtaacagtctacagtca

SEQ ID NO: 5199 - DNA, 28 bp, Artificial Sequence
  Synthetic
cagtcatttgggacagcaggcacagaca

SEQ ID NO: 5200 - DNA, 28 bp, Artificial Sequence
  Synthetic
cagtcatttgggaaatctcagctggcaa

SEQ ID NO: 5201 - DNA, 28 bp, Artificial Sequence
  Synthetic
cagtcatttgggtaatctctgcaggcaa

SEQ ID NO: 5202 - DNA, 28 bp, Artificial Sequence
  Synthetic
cagtcatttgggtactgcatcaggaact

SEQ ID NO: 5203 - DNA, 28 bp, Artificial Sequence
  Synthetic
cagtcatttgggttgtgcttgatctaac

SEQ ID NO: 5204 - DNA, 28 bp, Artificial Sequence
  Synthetic
cagtcatttgggttgtgcttgatctaac

SEQ ID NO: 5205 - DNA, 28 bp, Artificial Sequence
  Synthetic
cagtcatttgggtgattgtccaaacgca

SEQ ID NO: 5206 - DNA, 28 bp, Artificial Sequence
  Synthetic
cagtcatttgggagctacattgtctgct

SEQ ID NO: 5207 - DNA, 28 bp, Artificial Sequence
  Synthetic
cagtcatttgggagctacatctggctac

SEQ ID NO: 5208 - DNA, 28 bp, Artificial Sequence
  Synthetic
cagtcatttgggtgtcagtttgtcaaat

SEQ ID NO: 5209 - DNA, 28 bp, Artificial Sequence
  Synthetic
cagtcatttgggaagctgccagctgaag

SEQ ID NO: 5210 - DNA, 28 bp, Artificial Sequence
  Synthetic
cagtcatttgggaagctgccagttgaag

SEQ ID NO: 5211 - DNA, 28 bp, Artificial Sequence
  Synthetic
cagtcatttgggatcacattgccaggga

SEQ ID NO: 5212 - DNA, 28 bp, Artificial Sequence
  Synthetic
cagtcatttgggatcacattgccaggga

SEQ ID NO: 5213 - DNA, 28 bp, Artificial Sequence
  Synthetic
cagtcatttgggtggctcagttcagcag

SEQ ID NO: 5214 - DNA, 28 bp, Artificial Sequence
  Synthetic
cagtcatttgggcattgcacttgtctcg

SEQ ID NO: 5215 - DNA, 28 bp, Artificial Sequence
  Synthetic
cagtcatttgggttcaagtaatccagga

SEQ ID NO: 5216 - DNA, 28 bp, Artificial Sequence
  Synthetic
cagtcatttgggttcacagtggctaagt

SEQ ID NO: 5217 - DNA, 28 bp, Artificial Sequence
  Synthetic
cagtcatttgggttcacagtggttaagt

SEQ ID NO: 5218 - DNA, 28 bp, Artificial Sequence
  Synthetic
cagtcatttgggttcacagtggctaagt

SEQ ID NO: 5219 - DNA, 28 bp, Artificial Sequence
  Synthetic
cagtcatttgggtagcaccatttgaaat

SEQ ID NO: 5220 - DNA, 28 bp, Artificial Sequence
  Synthetic
cagtcatttgggtagcaccatttgaaat

SEQ ID NO: 5221 - DNA, 28 bp, Artificial Sequence
  Synthetic
cagtcatttgggcagtgcaatagtattg

SEQ ID NO: 5222 - DNA, 28 bp, Artificial Sequence
  Synthetic
cagtcatttgggtgtaaacatcctacac

SEQ ID NO: 5223 - DNA, 28 bp, Artificial Sequence
  Synthetic
cagtcatttgggtgtaaacatcctacac

SEQ ID NO: 5224 - DNA, 28 bp, Artificial Sequence
  Synthetic
cagtcatttgggtgtaaacatccccgac

SEQ ID NO: 5225 - DNA, 28 bp, Artificial Sequence
  Synthetic
cagtcatttgggtccagcatcagtgatt

SEQ ID NO: 5226 - DNA, 28 bp, Artificial Sequence
  Synthetic
cagtcatttgggtaatgcccctaaaaat

SEQ ID NO: 5227 - DNA, 28 bp, Artificial Sequence
  Synthetic
cagtcatttgggtttgttcgttcggctc

SEQ ID NO: 5228 - DNA, 28 bp, Artificial Sequence
  Synthetic
cagtcatttgggtaatactgtctggtaa

SEQ ID NO: 5229 - DNA, 28 bp, Artificial Sequence
  Synthetic
cagtcatttgggtatgtgcccttggact

SEQ ID NO: 5230 - DNA, 28 bp, Artificial Sequence
  Synthetic
cagtcatttgggatagctctttaaatgg

SEQ ID NO: 5231 - DNA, 28 bp, Artificial Sequence
  Synthetic
cagtcatttgggcacagcgcatacaatg

SEQ ID NO: 5232 - DNA, 28 bp, Artificial Sequence
  Synthetic
cagtcatttgggagtgacatcatatgta

SEQ ID NO: 5233 - DNA, 28 bp, Artificial Sequence
  Synthetic
cagtcatttgggtggaagactagtgatt

SEQ ID NO: 5234 - DNA, 28 bp, Artificial Sequence
  Synthetic
cagtcatttgggtctttggttatctagc

SEQ ID NO: 5235 - DNA, 28 bp, Artificial Sequence
  Synthetic
cagtcatttgggtattgcacttgtcccg

SEQ ID NO: 5236 - DNA, 28 bp, Artificial Sequence
  Synthetic
cagtcatttgggtttggcactagcacat

SEQ ID NO: 5237 - DNA, 28 bp, Artificial Sequence
  Synthetic
cagtcatttgggtgaggtagtaggttgt

SEQ ID NO: 5238 - DNA, 28 bp, Artificial Sequence
  Synthetic
cagtcatttgggtgaggtagtaggttgt

SEQ ID NO: 5239 - DNA, 28 bp, Artificial Sequence
  Synthetic
cagtcatttgggtgaggtagtaggttgt

SEQ ID NO: 5240 - DNA, 28 bp, Artificial Sequence
  Synthetic
cagtcatttgggagaggtagtgggttgc

SEQ ID NO: 5241 - DNA, 28 bp, Artificial Sequence
  Synthetic
cagtcatttgggtgaggtagtagattgt

SEQ ID NO: 5242 - DNA, 28 bp, Artificial Sequence
  Synthetic
cagtcatttgggtgaggtagtagtttgt

SEQ ID NO: 5243 - DNA, 28 bp, Artificial Sequence
  Synthetic
cagtcatttgggtgaggtagtagtttgt

SEQ ID NO: 5244 - DNA, 28 bp, Artificial Sequence
  Synthetic
cagtcatttgggtgaggtagtaggttgt

SEQ ID NO: 5245 - DNA, 28 bp, Artificial Sequence
  Synthetic
cagtcatttgggtgaggtagtagattga

SEQ ID NO: 5246 - DNA, 28 bp, Artificial Sequence
  Synthetic
cagtcatttgggaacccgtagatccgaa

SEQ ID NO: 5247 - DNA, 28 bp, Artificial Sequence
  Synthetic
cagtcatttgggtacagtactgtgataa

SEQ ID NO: 5248 - DNA, 28 bp, Artificial Sequence
  Synthetic
cagtcatttgggagcagcattgtacagg

SEQ ID NO: 5249 - DNA, 28 bp, Artificial Sequence
  Synthetic
cagtcatttgggaaaagtgcttacagtg

SEQ ID NO: 5250 - DNA, 28 bp, Artificial Sequence
  Synthetic
cagtcatttgggagcagcattgtacagg

SEQ ID NO: 5251 - DNA, 28 bp, Artificial Sequence
  Synthetic
cagtcatttgggtaccctgtagaaccga

SEQ ID NO: 5252 - DNA, 28 bp, Artificial Sequence
  Synthetic
cagtcatttgggtggagtgtgacaatgg

SEQ ID NO: 5253 - DNA, 28 bp, Artificial Sequence
  Synthetic
cagtcatttgggttaaggcacgcggtga

SEQ ID NO: 5254 - DNA, 28 bp, Artificial Sequence
  Synthetic
cagtcatttgggttaaggcacgcagtga

SEQ ID NO: 5255 - DNA, 28 bp, Artificial Sequence
  Synthetic
cagtcatttgggtccctgagaccctaac

SEQ ID NO: 5256 - DNA, 28 bp, Artificial Sequence
  Synthetic
cagtcatttgggtcgtaccgtgagtaat

SEQ ID NO: 5257 - DNA, 28 bp, Artificial Sequence
  Synthetic
cagtcatttgggcattattacttttggt

SEQ ID NO: 5258 - DNA, 28 bp, Artificial Sequence
  Synthetic
cagtcatttgggtcacagtgaaccggtc

SEQ ID NO: 5259 - DNA, 28 bp, Artificial Sequence
  Synthetic
cagtcatttgggcagtgcaatattaaaa

SEQ ID NO: 5260 - DNA, 28 bp, Artificial Sequence
  Synthetic
cagtcatttgggcagtgcaataatgaaa

SEQ ID NO: 5261 - DNA, 28 bp, Artificial Sequence
  Synthetic
cagtcatttgggttggtccccttcaacc

SEQ ID NO: 5262 - DNA, 28 bp, Artificial Sequence
  Synthetic
cagtcatttgggttggtccccttcaacc

SEQ ID NO: 5263 - DNA, 28 bp, Artificial Sequence
  Synthetic
cagtcatttgggttggtccccttcaacc

SEQ ID NO: 5264 - DNA, 28 bp, Artificial Sequence
  Synthetic
cagtcatttgggtatggctttttattcc

SEQ ID NO: 5265 - DNA, 28 bp, Artificial Sequence
  Synthetic
cagtcatttgggtattgcttaagaatac

SEQ ID NO: 5266 - DNA, 28 bp, Artificial Sequence
  Synthetic
cagtcatttgggagctggtgttgtgaat

SEQ ID NO: 5267 - DNA, 28 bp, Artificial Sequence
  Synthetic
cagtcatttgggagtggttttaccctat

SEQ ID NO: 5268 - DNA, 28 bp, Artificial Sequence
  Synthetic
cagtcatttgggccacagggtagaacca

SEQ ID NO: 5269 - DNA, 28 bp, Artificial Sequence
  Synthetic
cagtcatttgggtgtagtgtttcctact

SEQ ID NO: 5270 - DNA, 28 bp, Artificial Sequence
  Synthetic
cagtcatttgggcccataaagtagaaag

SEQ ID NO: 5271 - DNA, 28 bp, Artificial Sequence
  Synthetic
cagtcatttgggctacagtatagatgat

SEQ ID NO: 5272 - DNA, 28 bp, Artificial Sequence
  Synthetic
cagtcatttgggtgagaactgaattcca

SEQ ID NO: 5273 - DNA, 28 bp, Artificial Sequence
  Synthetic
cagtcatttgggtgagaactgaattcca

SEQ ID NO: 5274 - DNA, 28 bp, Artificial Sequence
  Synthetic
cagtcatttgggccctatggattcagtt

SEQ ID NO: 5275 - DNA, 28 bp, Artificial Sequence
  Synthetic
cagtcatttggggtgtgcggaaatgctt

SEQ ID NO: 5276 - DNA, 28 bp, Artificial Sequence
  Synthetic
cagtcatttgggtcagtgcactacagaa

SEQ ID NO: 5277 - DNA, 28 bp, Artificial Sequence
  Synthetic
cagtcatttgggttgcatagtcacaaaa

SEQ ID NO: 5278 - DNA, 28 bp, Artificial Sequence
  Synthetic
cagtcatttgggttaatgctaatcgtga

SEQ ID NO: 5279 - DNA, 28 bp, Artificial Sequence
  Synthetic
cagtcatttgggtagcagcacataatgg

SEQ ID NO: 5280 - DNA, 28 bp, Artificial Sequence
  Synthetic
cagtcatttgggtagcagcacatcatgg

SEQ ID NO: 5281 - DNA, 28 bp, Artificial Sequence
  Synthetic
cagtcatttgggtagcagcacgtaaata

SEQ ID NO: 5282 - DNA, 28 bp, Artificial Sequence
  Synthetic
cagtcatttgggactgcagtgaaggcac

SEQ ID NO: 5283 - DNA, 28 bp, Artificial Sequence
  Synthetic
cagtcatttgggcaaagtgcttacagtg

SEQ ID NO: 5284 - DNA, 28 bp, Artificial Sequence
  Synthetic
cagtcatttgggaacattcaacgctgtc

SEQ ID NO: 5285 - DNA, 28 bp, Artificial Sequence
  Synthetic
cagtcatttgggaccatcgaccgttgat

SEQ ID NO: 5286 - DNA, 28 bp, Artificial Sequence
  Synthetic
cagtcatttgggaacattcattgctgtc

SEQ ID NO: 5287 - DNA, 28 bp, Artificial Sequence
  Synthetic
cagtcatttgggtatggcactggtagaa

SEQ ID NO: 5288 - DNA, 28 bp, Artificial Sequence
  Synthetic
cagtcatttgggtggacggagaactgat

SEQ ID NO: 5289 - DNA, 28 bp, Artificial Sequence
  Synthetic
cagtcatttgggtcgtgtcttgtgttgc

SEQ ID NO: 5290 - DNA, 28 bp, Artificial Sequence
  Synthetic
cagtcatttgggtaaggtgcatctagtg

SEQ ID NO: 5291 - DNA, 28 bp, Artificial Sequence
  Synthetic
cagtcatttgggtaaggtgcatctagtg

SEQ ID NO: 5292 - DNA, 28 bp, Artificial Sequence
  Synthetic
cagtcatttgggtgatatgtttgatata

SEQ ID NO: 5293 - DNA, 28 bp, Artificial Sequence
  Synthetic
cagtcatttgggaactggcccacaaagt

SEQ ID NO: 5294 - DNA, 28 bp, Artificial Sequence
  Synthetic
cagtcatttgggtgtaacagcaactcca

SEQ ID NO: 5295 - DNA, 28 bp, Artificial Sequence
  Synthetic
cagtcatttgggtaggtagtttcatgtt

SEQ ID NO: 5296 - DNA, 28 bp, Artificial Sequence
  Synthetic
cagtcatttgggcccagtgttcagacta

SEQ ID NO: 5297 - DNA, 28 bp, Artificial Sequence
  Synthetic
cagtcatttgggtacagtagtctgcaca

SEQ ID NO: 5298 - DNA, 28 bp, Artificial Sequence
  Synthetic
cagtcatttgggtgtgcaaatctatgca

SEQ ID NO: 5299 - DNA, 28 bp, Artificial Sequence
  Synthetic
cagtcatttgggtgtgcaaatccatgca

SEQ ID NO: 5300 - DNA, 28 bp, Artificial Sequence
  Synthetic
cagtcatttgggtggaatgtaaagaagt

SEQ ID NO: 5301 - DNA, 28 bp, Artificial Sequence
  Synthetic
cagtcatttgggtggaatgttaagaagt

SEQ ID NO: 5302 - DNA, 28 bp, Artificial Sequence
  Synthetic
cagtcatttgggtaacactgtctggtaa

SEQ ID NO: 5303 - DNA, 28 bp, Artificial Sequence
  Synthetic
cagtcatttgggtaatactgcctggtaa

SEQ ID NO: 5304 - DNA, 28 bp, Artificial Sequence
  Synthetic
cagtcatttgggagaggcatagagcatg

SEQ ID NO: 5305 - DNA, 28 bp, Artificial Sequence
  Synthetic
cagtcatttgggtttcctatgcatatac

SEQ ID NO: 5306 - DNA, 28 bp, Artificial Sequence
  Synthetic
cagtcatttggggtgaaatgtttaggac

SEQ ID NO: 5307 - DNA, 28 bp, Artificial Sequence
  Synthetic
cagtcatttgggttccctttgtcatcct

SEQ ID NO: 5308 - DNA, 28 bp, Artificial Sequence
  Synthetic
cagtcatttgggtccttcattccaccgg

SEQ ID NO: 5309 - DNA, 28 bp, Artificial Sequence
  Synthetic
cagtcatttgggcccttcattccaccgg

SEQ ID NO: 5310 - DNA, 28 bp, Artificial Sequence
  Synthetic
cagtcatttgggtggaatgtaaggaagt

SEQ ID NO: 5311 - DNA, 28 bp, Artificial Sequence
  Synthetic
cagtcatttgggtaaagtgcttatagtg

SEQ ID NO: 5312 - DNA, 28 bp, Artificial Sequence
  Synthetic
cagtcatttgggcaaagtgctcatagtg

SEQ ID NO: 5313 - DNA, 28 bp, Artificial Sequence
  Synthetic
cagtcatttgggtagcttatcagactga

SEQ ID NO: 5314 - DNA, 28 bp, Artificial Sequence
  Synthetic
cagtcatttgggttccctttgtcatcct

SEQ ID NO: 5315 - DNA, 28 bp, Artificial Sequence
  Synthetic
cagtcatttgggatgacctatgaattga

SEQ ID NO: 5316 - DNA, 28 bp, Artificial Sequence
  Synthetic
cagtcatttgggtaatctcagctggcaa

SEQ ID NO: 5317 - DNA, 28 bp, Artificial Sequence
  Synthetic
cagtcatttgggtactgcatcaggaact

SEQ ID NO: 5318 - DNA, 28 bp, Artificial Sequence
  Synthetic
cagtcatttgggttgtgcttgatctaac

SEQ ID NO: 5319 - DNA, 28 bp, Artificial Sequence
  Synthetic
cagtcatttgggtgattgtccaaacgca

SEQ ID NO: 5320 - DNA, 28 bp, Artificial Sequence
  Synthetic
cagtcatttgggagctacattgtctgct

SEQ ID NO: 5321 - DNA, 28 bp, Artificial Sequence
  Synthetic
cagtcatttgggagctacatctggctac

SEQ ID NO: 5322 - DNA, 28 bp, Artificial Sequence
  Synthetic
cagtcatttgggaactacatctggctac

SEQ ID NO: 5323 - DNA, 28 bp, Artificial Sequence
  Synthetic
cagtcatttgggtgtcagtttgtcaaat

SEQ ID NO: 5324 - DNA, 28 bp, Artificial Sequence
  Synthetic
cagtcatttgggatcacattgccaggga

SEQ ID NO: 5325 - DNA, 28 bp, Artificial Sequence
  Synthetic
cagtcatttgggtggctcagttcagcag

SEQ ID NO: 5326 - DNA, 28 bp, Artificial Sequence
  Synthetic
cagtcatttgggttcaagtaatccagga

SEQ ID NO: 5327 - DNA, 28 bp, Artificial Sequence
  Synthetic
cagtcatttgggttcacagtggctaagt

SEQ ID NO: 5328 - DNA, 28 bp, Artificial Sequence
  Synthetic
cagtcatttgggtagcaccatttgaaat

SEQ ID NO: 5329 - DNA, 28 bp, Artificial Sequence
  Synthetic
cagtcatttgggtagcaccatttgaaat

SEQ ID NO: 5330 - DNA, 28 bp, Artificial Sequence
  Synthetic
cagtcatttgggtagcaccatttgaaat

SEQ ID NO: 5331 - DNA, 28 bp, Artificial Sequence
  Synthetic
cagtcatttgggcagtgcaataatattg

SEQ ID NO: 5332 - DNA, 28 bp, Artificial Sequence
  Synthetic
cagtcatttgggaagtgcttccatgttt

SEQ ID NO: 5333 - DNA, 28 bp, Artificial Sequence
  Synthetic
cagtcatttgggtaagtgcttccatgtt

SEQ ID NO: 5334 - DNA, 28 bp, Artificial Sequence
  Synthetic
cagtcatttgggactttaacatggaggt

SEQ ID NO: 5335 - DNA, 28 bp, Artificial Sequence
  Synthetic
cagtcatttgggtaagtgcttccatgtt

SEQ ID NO: 5336 - DNA, 28 bp, Artificial Sequence
  Synthetic
cagtcatttgggtttaacatggaggtac

SEQ ID NO: 5337 - DNA, 28 bp, Artificial Sequence
  Synthetic
cagtcatttgggtaagtgcttccatgtt

SEQ ID NO: 5338 - DNA, 28 bp, Artificial Sequence
  Synthetic
cagtcatttgggctttcagtcggatgtt

SEQ ID NO: 5339 - DNA, 28 bp, Artificial Sequence
  Synthetic
cagtcatttgggtgtaaacatcctcgac

SEQ ID NO: 5340 - DNA, 28 bp, Artificial Sequence
  Synthetic
cagtcatttgggtgtaaacatcctacac

SEQ ID NO: 5341 - DNA, 28 bp, Artificial Sequence
  Synthetic
cagtcatttgggtgtaaacatcctacac

SEQ ID NO: 5342 - DNA, 28 bp, Artificial Sequence
  Synthetic
cagtcatttgggtgtaaacatccccgac

SEQ ID NO: 5343 - DNA, 28 bp, Artificial Sequence
  Synthetic
cagtcatttgggtgtaaacatccttgac

SEQ ID NO: 5344 - DNA, 28 bp, Artificial Sequence
  Synthetic
cagtcatttgggaggcaagatgttggca

SEQ ID NO: 5345 - DNA, 28 bp, Artificial Sequence
  Synthetic
cagtcatttgggtattgcacattactaa

SEQ ID NO: 5346 - DNA, 28 bp, Artificial Sequence
  Synthetic
cagtcatttggggtgcattgtagttgca

SEQ ID NO: 5347 - DNA, 28 bp, Artificial Sequence
  Synthetic
cagtcatttgggtggcagtgtcttagct

SEQ ID NO: 5348 - DNA, 28 bp, Artificial Sequence
  Synthetic
cagtcatttgggcaggcagtgtagttag

SEQ ID NO: 5349 - DNA, 28 bp, Artificial Sequence
  Synthetic
cagtcatttgggaggcagtgtagttagc

SEQ ID NO: 5350 - DNA, 28 bp, Artificial Sequence
  Synthetic
cagtcatttgggtaatgcccctaaaaat

SEQ ID NO: 5351 - DNA, 28 bp, Artificial Sequence
  Synthetic
cagtcatttgggaattgcactttagcaa

SEQ ID NO: 5352 - DNA, 28 bp, Artificial Sequence
  Synthetic
cagtcatttgggtttgttcgttcggctc

SEQ ID NO: 5353 - DNA, 28 bp, Artificial Sequence
  Synthetic
cagtcatttgggagatcagaaggtgatt

SEQ ID NO: 5354 - DNA, 28 bp, Artificial Sequence
  Synthetic
cagtcatttgggtaatactgtctggtaa

SEQ ID NO: 5355 - DNA, 28 bp, Artificial Sequence
  Synthetic
cagtcatttgggtggcagtgtatgttag

SEQ ID NO: 5356 - DNA, 28 bp, Artificial Sequence
  Synthetic
cagtcatttgggaaaccgttaccattac

SEQ ID NO: 5357 - DNA, 28 bp, Artificial Sequence
  Synthetic
cagtcatttgggtatgtgcccttggact

SEQ ID NO: 5358 - DNA, 28 bp, Artificial Sequence
  Synthetic
cagtcatttgggcaggctggttagatgg

SEQ ID NO: 5359 - DNA, 28 bp, Artificial Sequence
  Synthetic
cagtcatttgggcctgcattgtacacac

SEQ ID NO: 5360 - DNA, 28 bp, Artificial Sequence
  Synthetic
cagtcatttgggatatatacacacacac

SEQ ID NO: 5361 - DNA, 28 bp, Artificial Sequence
  Synthetic
cagtcatttgggagtgacatcatatgta

SEQ ID NO: 5362 - DNA, 28 bp, Artificial Sequence
  Synthetic
cagtcatttgggcaacctggaggactcc

SEQ ID NO: 5363 - DNA, 28 bp, Artificial Sequence
  Synthetic
cagtcatttgggttaagacttgtagtga

SEQ ID NO: 5364 - DNA, 28 bp, Artificial Sequence
  Synthetic
cagtcatttgggtggaagactagtgatt

SEQ ID NO: 5365 - DNA, 28 bp, Artificial Sequence
  Synthetic
cagtcatttggggcagagctgcagatgg

SEQ ID NO: 5366 - DNA, 28 bp, Artificial Sequence
  Synthetic
cagtcatttgggtggaagactagtgatt

SEQ ID NO: 5367 - DNA, 28 bp, Artificial Sequence
  Synthetic
cagtcatttgggtctttggttatctagc

SEQ ID NO: 5368 - DNA, 28 bp, Artificial Sequence
  Synthetic
cagtcatttgggtaaagctagagaaccg

SEQ ID NO: 5369 - DNA, 28 bp, Artificial Sequence
  Synthetic
cagtcatttgggtattgcacttgtcccg

SEQ ID NO: 5370 - DNA, 28 bp, Artificial Sequence
  Synthetic
cagtcatttgggaacccgtagatccgat

SEQ ID NO: 5371 - DNA, 28 bp, Artificial Sequence
  Synthetic
cagtcatttgggaacccgtagatccgaa

SEQ ID NO: 5372 - DNA, 28 bp, Artificial Sequence
  Synthetic
cagtcatttgggtacagtactgtgataa

SEQ ID NO: 5373 - DNA, 28 bp, Artificial Sequence
  Synthetic
cagtcatttgggagcagcattgtacagg

SEQ ID NO: 5374 - DNA, 28 bp, Artificial Sequence
  Synthetic
cagtcatttgggtcaaatgctcagactc

SEQ ID NO: 5375 - DNA, 28 bp, Artificial Sequence
  Synthetic
cagtcatttgggaaaagtgcttacagtg

SEQ ID NO: 5376 - DNA, 28 bp, Artificial Sequence
  Synthetic
cagtcatttgggtaaagtgctgacagtg

SEQ ID NO: 5377 - DNA, 28 bp, Artificial Sequence
  Synthetic
cagtcatttgggagcagcattgtacagg

SEQ ID NO: 5378 - DNA, 28 bp, Artificial Sequence
  Synthetic
cagtcatttgggtaccctgtagatccga

SEQ ID NO: 5379 - DNA, 28 bp, Artificial Sequence
  Synthetic
cagtcatttgggtaccctgtagaaccga

SEQ ID NO: 5380 - DNA, 28 bp, Artificial Sequence
  Synthetic
cagtcatttgggttaaggcacgcggtga

SEQ ID NO: 5381 - DNA, 28 bp, Artificial Sequence
  Synthetic
cagtcatttgggtccctgagaccctaac

SEQ ID NO: 5382 - DNA, 28 bp, Artificial Sequence
  Synthetic
cagtcatttgggcagtgcaatgttaaaa

SEQ ID NO: 5383 - DNA, 28 bp, Artificial Sequence
  Synthetic
cagtcatttgggttggtccccttcaacc

SEQ ID NO: 5384 - DNA, 28 bp, Artificial Sequence
  Synthetic
cagtcatttgggtgtgactggttgacca

SEQ ID NO: 5385 - DNA, 28 bp, Artificial Sequence
  Synthetic
cagtcatttgggtatggctttttattcc

SEQ ID NO: 5386 - DNA, 28 bp, Artificial Sequence
  Synthetic
cagtcatttgggactccatttgttttga

SEQ ID NO: 5387 - DNA, 28 bp, Artificial Sequence
  Synthetic
cagtcatttgggaacactgtctggtaaa

SEQ ID NO: 5388 - DNA, 28 bp, Artificial Sequence
  Synthetic
cagtcatttgggtgagatgaagcactgt

SEQ ID NO: 5389 - DNA, 28 bp, Artificial Sequence
  Synthetic
cagtcatttggggtccagttttcccagg

SEQ ID NO: 5390 - DNA, 28 bp, Artificial Sequence
  Synthetic
cagtcatttgggttgcatagtcacaaaa

SEQ ID NO: 5391 - DNA, 28 bp, Artificial Sequence
  Synthetic
cagtcatttgggtaggttatccgtgttg

SEQ ID NO: 5392 - DNA, 28 bp, Artificial Sequence
  Synthetic
cagtcatttgggtagcagcacataatgg

SEQ ID NO: 5393 - DNA, 28 bp, Artificial Sequence
  Synthetic
cagtcatttgggtagcagcacatcatgg

SEQ ID NO: 5394 - DNA, 28 bp, Artificial Sequence
  Synthetic
cagtcatttgggtagcagcacgtaaata

SEQ ID NO: 5395 - DNA, 28 bp, Artificial Sequence
  Synthetic
cagtcatttgggactgcagtgaaggcac

SEQ ID NO: 5396 - DNA, 28 bp, Artificial Sequence
  Synthetic
cagtcatttgggcaaagtgcttacagtg

SEQ ID NO: 5397 - DNA, 28 bp, Artificial Sequence
  Synthetic
cagtcatttgggtaaggtgcatctagtg

SEQ ID NO: 5398 - DNA, 28 bp, Artificial Sequence
  Synthetic
cagtcatttgggaacattcaacgctgtc

SEQ ID NO: 5399 - DNA, 28 bp, Artificial Sequence
  Synthetic
cagtcatttgggaccatcgaccgttgat

SEQ ID NO: 5400 - DNA, 28 bp, Artificial Sequence
  Synthetic
cagtcatttgggaacattcattgctgtc

SEQ ID NO: 5401 - DNA, 28 bp, Artificial Sequence
  Synthetic
cagtcatttgggaacattcaacctgtcg

SEQ ID NO: 5402 - DNA, 28 bp, Artificial Sequence
  Synthetic
cagtcatttgggtatggcactggtagaa

SEQ ID NO: 5403 - DNA, 28 bp, Artificial Sequence
  Synthetic
cagtcatttgggcaaagaattctccttt

SEQ ID NO: 5404 - DNA, 28 bp, Artificial Sequence
  Synthetic
cagtcatttgggtcgtgtcttgtgttgc

SEQ ID NO: 5405 - DNA, 28 bp, Artificial Sequence
  Synthetic
cagtcatttgggtgatatgtttgatata

SEQ ID NO: 5406 - DNA, 28 bp, Artificial Sequence
  Synthetic
cagtcatttgggtgtaacagcaactcca

SEQ ID NO: 5407 - DNA, 28 bp, Artificial Sequence
  Synthetic
cagtcatttgggtagcagcacagaaata

SEQ ID NO: 5408 - DNA, 28 bp, Artificial Sequence
  Synthetic
cagtcatttgggtaggtagtttcatgtt

SEQ ID NO: 5409 - DNA, 28 bp, Artificial Sequence
  Synthetic
cagtcatttgggggtccagaggggagat

SEQ ID NO: 5410 - DNA, 28 bp, Artificial Sequence
  Synthetic
cagtcatttgggcccagtgttcagacta

SEQ ID NO: 5411 - DNA, 28 bp, Artificial Sequence
  Synthetic
cagtcatttgggtgtgcaaatctatgca

SEQ ID NO: 5412 - DNA, 28 bp, Artificial Sequence
  Synthetic
cagtcatttgggtgtgcaaatccatgca

SEQ ID NO: 5413 - DNA, 28 bp, Artificial Sequence
  Synthetic
cagtcatttgggtaaagtgcttatagtg

SEQ ID NO: 5414 - DNA, 28 bp, Artificial Sequence
  Synthetic
cagtcatttgggaatactgccgggtaat

SEQ ID NO: 5415 - DNA, 28 bp, Artificial Sequence
  Synthetic
cagtcatttgggttccctttgtcatcct

SEQ ID NO: 5416 - DNA, 28 bp, Artificial Sequence
  Synthetic
cagtcatttgggtccttcattccaccgg

SEQ ID NO: 5417 - DNA, 28 bp, Artificial Sequence
  Synthetic
cagtcatttgggtagcttatcagactga

SEQ ID NO: 5418 - DNA, 28 bp, Artificial Sequence
  Synthetic
cagtcatttgggacagcaggcacagaca

SEQ ID NO: 5419 - DNA, 28 bp, Artificial Sequence
  Synthetic
cagtcatttgggatgacctatgaattga

SEQ ID NO: 5420 - DNA, 28 bp, Artificial Sequence
  Synthetic
cagtcatttgggtaatctcagctggcaa

SEQ ID NO: 5421 - DNA, 28 bp, Artificial Sequence
  Synthetic
cagtcatttgggtactgcatcaggaact

SEQ ID NO: 5422 - DNA, 28 bp, Artificial Sequence
  Synthetic
cagtcatttgggttgtgcttgatctaac

SEQ ID NO: 5423 - DNA, 28 bp, Artificial Sequence
  Synthetic
cagtcatttgggtgattgtccaaacgca

SEQ ID NO: 5424 - DNA, 28 bp, Artificial Sequence
  Synthetic
cagtcatttgggccacaccgtgtctgac

SEQ ID NO: 5425 - DNA, 28 bp, Artificial Sequence
  Synthetic
cagtcatttgggagctacattgtctgct

SEQ ID NO: 5426 - DNA, 28 bp, Artificial Sequence
  Synthetic
cagtcatttgggtgtcagtttgtcaaat

SEQ ID NO: 5427 - DNA, 28 bp, Artificial Sequence
  Synthetic
cagtcatttgggcaagtcactagtggtt

SEQ ID NO: 5428 - DNA, 28 bp, Artificial Sequence
  Synthetic
cagtcatttgggatcacattgccaggga

SEQ ID NO: 5429 - DNA, 28 bp, Artificial Sequence
  Synthetic
cagtcatttgggtggctcagttcagcag

SEQ ID NO: 5430 - DNA, 28 bp, Artificial Sequence
  Synthetic
cagtcatttgggcattgcacttgtctcg

SEQ ID NO: 5431 - DNA, 28 bp, Artificial Sequence
  Synthetic
cagtcatttgggttcaagtaatccagga

SEQ ID NO: 5432 - DNA, 28 bp, Artificial Sequence
  Synthetic
cagtcatttgggttcacagtggctaagt

SEQ ID NO: 5433 - DNA, 28 bp, Artificial Sequence
  Synthetic
cagtcatttgggaaggagctcacagtct

SEQ ID NO: 5434 - DNA, 28 bp, Artificial Sequence
  Synthetic
cagtcatttgggctagcaccatctgaaa

SEQ ID NO: 5435 - DNA, 28 bp, Artificial Sequence
  Synthetic
cagtcatttgggtagcaccatttgaaat

SEQ ID NO: 5436 - DNA, 28 bp, Artificial Sequence
  Synthetic
cagtcatttgggctttcagtcggatgtt

SEQ ID NO: 5437 - DNA, 28 bp, Artificial Sequence
  Synthetic
cagtcatttgggtgtaaacatcctcgac

SEQ ID NO: 5438 - DNA, 28 bp, Artificial Sequence
  Synthetic
cagtcatttgggtgtaaacatcctacac

SEQ ID NO: 5439 - DNA, 28 bp, Artificial Sequence
  Synthetic
cagtcatttgggtgtaaacatccccgac

SEQ ID NO: 5440 - DNA, 28 bp, Artificial Sequence
  Synthetic
cagtcatttgggggcaagatgctggcat

SEQ ID NO: 5441 - DNA, 28 bp, Artificial Sequence
  Synthetic
cagtcatttgggtattgcacattactaa

SEQ ID NO: 5442 - DNA, 28 bp, Artificial Sequence
  Synthetic
cagtcatttggggtgcattgtagttgca

SEQ ID NO: 5443 - DNA, 28 bp, Artificial Sequence
  Synthetic
cagtcatttgggtggcagtgtcttagct

SEQ ID NO: 5444 - DNA, 28 bp, Artificial Sequence
  Synthetic
cagtcatttgggtggaagactagtgatt

SEQ ID NO: 5445 - DNA, 28 bp, Artificial Sequence
  Synthetic
cagtcatttgggtctttggttatctagc

SEQ ID NO: 5446 - DNA, 28 bp, Artificial Sequence
  Synthetic
cagtcatttgggtattgcacttgtcccg

SEQ ID NO: 5447 - DNA, 28 bp, Artificial Sequence
  Synthetic
cagtcatttgggaaagtgctgttcgtgc

SEQ ID NO: 5448 - DNA, 28 bp, Artificial Sequence
  Synthetic
cagtcatttgggttcaacgggtatttat

SEQ ID NO: 5449 - DNA, 28 bp, Artificial Sequence
  Synthetic
cagtcatttgggtttggcactagcacat

SEQ ID NO: 5450 - DNA, 28 bp, Artificial Sequence
  Synthetic
cagtcatttgggtgaggtagtaagttgt

SEQ ID NO: 5451 - DNA, 28 bp, Artificial Sequence
  Synthetic
cagtcatttgggaacccgtagatccgat

SEQ ID NO: 5452 - DNA, 28 bp, Artificial Sequence
  Synthetic
cagtcatttgggtgacagaagagagtga

SEQ ID NO: 5453 - DNA, 28 bp, Artificial Sequence
  Synthetic
cagtcatttgggtgacagaagagagaga

SEQ ID NO: 5454 - DNA, 28 bp, Artificial Sequence
  Synthetic
cagtcatttgggttgacagaagatagag

SEQ ID NO: 5455 - DNA, 28 bp, Artificial Sequence
  Synthetic
cagtcatttgggttgacagaagatagag

SEQ ID NO: 5456 - DNA, 28 bp, Artificial Sequence
  Synthetic
cagtcatttgggttgacagaagatagag

SEQ ID NO: 5457 - DNA, 28 bp, Artificial Sequence
  Synthetic
cagtcatttgggtttggattgaagggag

SEQ ID NO: 5458 - DNA, 28 bp, Artificial Sequence
  Synthetic
cagtcatttgggtgcctggctccctgta

SEQ ID NO: 5459 - DNA, 28 bp, Artificial Sequence
  Synthetic
cagtcatttgggtcggaccaggcttcat

SEQ ID NO: 5460 - DNA, 28 bp, Artificial Sequence
  Synthetic
cagtcatttgggtcggaccaggcttcat

SEQ ID NO: 5461 - DNA, 28 bp, Artificial Sequence
  Synthetic
cagtcatttgggtgaagctgccagcatg

SEQ ID NO: 5462 - DNA, 28 bp, Artificial Sequence
  Synthetic
cagtcatttgggtgaagctgccagcatg

SEQ ID NO: 5463 - DNA, 28 bp, Artificial Sequence
  Synthetic
cagtcatttgggtcgcttggtgcaggtc

SEQ ID NO: 5464 - DNA, 28 bp, Artificial Sequence
  Synthetic
cagtcatttgggcagccaaggatgactt

SEQ ID NO: 5465 - DNA, 28 bp, Artificial Sequence
  Synthetic
cagtcatttgggagaatcttgatgatgc

SEQ ID NO: 5466 - DNA, 28 bp, Artificial Sequence
  Synthetic
cagtcatttgggagaatcttgatgatgc

SEQ ID NO: 5467 - DNA, 28 bp, Artificial Sequence
  Synthetic
cagtcatttgggttggactgaagggagc

SEQ ID NO: 5468 - DNA, 28 bp, Artificial Sequence
  Synthetic
cagtcatttgggttggactgaagggagc

SEQ ID NO: 5469 - DNA, 28 bp, Artificial Sequence
  Synthetic
cagtcatttgggttggactgaaaggagc

SEQ ID NO: 5470 - DNA, 28 bp, Artificial Sequence
  Synthetic
cagtcatttgggttccacagctttcttg

SEQ ID NO: 5471 - DNA, 28 bp, Artificial Sequence
  Synthetic
cagtcatttgggttccacagctttcttg

SEQ ID NO: 5472 - DNA, 28 bp, Artificial Sequence
  Synthetic
cagtcatttgggtgtgttctcaggtcac

SEQ ID NO: 5473 - DNA, 28 bp, Artificial Sequence
  Synthetic
cagtcatttgggtgtgttctcaggtcac

SEQ ID NO: 5474 - DNA, 28 bp, Artificial Sequence
  Synthetic
cagtcatttgggaagtgacggtgagatc

SEQ ID NO: 5475 - DNA, 28 bp, Artificial Sequence
  Synthetic
cagtcatttgggtcgtcctccccttctt

SEQ ID NO: 5476 - DNA, 28 bp, Artificial Sequence
  Synthetic
cagtcatttgggtaactagccttcccgt

SEQ ID NO: 5477 - DNA, 28 bp, Artificial Sequence
  Synthetic
cagtcatttgggtcaccagaatgctagt

SEQ ID NO: 5478 - DNA, 28 bp, Artificial Sequence
  Synthetic
cagtcatttgggtcgttgaagacacctg

SEQ ID NO: 5479 - DNA, 28 bp, Artificial Sequence
  Synthetic
cagtcatttgggggggatgggctggcgc

SEQ ID NO: 5480 - DNA, 28 bp, Artificial Sequence
  Synthetic
cagtcatttgggtgcgtctcggcctcgt

SEQ ID NO: 5481 - DNA, 28 bp, Artificial Sequence
  Synthetic
cagtcatttgggaaccgctcagtggctc

SEQ ID NO: 5482 - DNA, 28 bp, Artificial Sequence
  Synthetic
cagtcatttgggatccacttggagagct

SEQ ID NO: 5483 - DNA, 28 bp, Artificial Sequence
  Synthetic
cagtcatttgggagcggtctgttcaggt

SEQ ID NO: 5484 - DNA, 28 bp, Artificial Sequence
  Synthetic
cagtcatttggggattgtgcccggaccg

SEQ ID NO: 5485 - DNA, 28 bp, Artificial Sequence
  Synthetic
cagtcatttgggcgacatggacgtgcag

SEQ ID NO: 5486 - DNA, 28 bp, Artificial Sequence
  Synthetic
cagtcatttgggtgacaagcctgacgag

SEQ ID NO: 5487 - DNA, 28 bp, Artificial Sequence
  Synthetic
cagtcatttgggttatgataggtgtgac

SEQ ID NO: 5488 - DNA, 28 bp, Artificial Sequence
  Synthetic
cagtcatttgggtgaggtagtaggttgt

SEQ ID NO: 5489 - DNA, 28 bp, Artificial Sequence
  Synthetic
cagtcatttgggtgaggtagtaggttgt

SEQ ID NO: 5490 - DNA, 28 bp, Artificial Sequence
  Synthetic
cagtcatttgggtgaggtagtaggttgt

SEQ ID NO: 5491 - DNA, 28 bp, Artificial Sequence
  Synthetic
cagtcatttgggagaggtagtaggttgc

SEQ ID NO: 5492 - DNA, 28 bp, Artificial Sequence
  Synthetic
cagtcatttgggtgaggtaggaggttgt

SEQ ID NO: 5493 - DNA, 28 bp, Artificial Sequence
  Synthetic
cagtcatttgggtgaggtagtagattgt

SEQ ID NO: 5494 - DNA, 28 bp, Artificial Sequence
  Synthetic
cagtcatttgggtgaggtagtagtttgt

SEQ ID NO: 5495 - DNA, 28 bp, Artificial Sequence
  Synthetic
cagtcatttgggtgaggtagtagtttgt

SEQ ID NO: 5496 - DNA, 28 bp, Artificial Sequence
  Synthetic
cagtcatttgggtggaatgtaaagaagt

SEQ ID NO: 5497 - DNA, 28 bp, Artificial Sequence
  Synthetic
cagtcatttgggaacccgtagatccgaa

SEQ ID NO: 5498 - DNA, 28 bp, Artificial Sequence
  Synthetic
cagtcatttgggtacagtactgtgataa

SEQ ID NO: 5499 - DNA, 28 bp, Artificial Sequence
  Synthetic
cagtcatttgggagcagcattgtacagg

SEQ ID NO: 5500 - DNA, 28 bp, Artificial Sequence
  Synthetic
cagtcatttgggtcaaatgctcagactc

SEQ ID NO: 5501 - DNA, 28 bp, Artificial Sequence
  Synthetic
cagtcatttgggaaaagtgcttacagtg

SEQ ID NO: 5502 - DNA, 28 bp, Artificial Sequence
  Synthetic
cagtcatttgggtaaagtgctgacagtg

SEQ ID NO: 5503 - DNA, 28 bp, Artificial Sequence
  Synthetic
cagtcatttgggagcagcattgtacagg

SEQ ID NO: 5504 - DNA, 28 bp, Artificial Sequence
  Synthetic
cagtcatttgggtaccctgtagatccga

SEQ ID NO: 5505 - DNA, 28 bp, Artificial Sequence
  Synthetic
cagtcatttgggtaccctgtagaaccga

SEQ ID NO: 5506 - DNA, 28 bp, Artificial Sequence
  Synthetic
cagtcatttgggtggagtgtgacaatgg

SEQ ID NO: 5507 - DNA, 28 bp, Artificial Sequence
  Synthetic
cagtcatttgggttaaggcacgcggtga

SEQ ID NO: 5508 - DNA, 28 bp, Artificial Sequence
  Synthetic
cagtcatttgggtccctgagacccttta

SEQ ID NO: 5509 - DNA, 28 bp, Artificial Sequence
  Synthetic
cagtcatttgggtccctgagaccctaac

SEQ ID NO: 5510 - DNA, 28 bp, Artificial Sequence
  Synthetic
cagtcatttgggtcgtaccgtgagtaat

SEQ ID NO: 5511 - DNA, 28 bp, Artificial Sequence
  Synthetic
cagtcatttgggcattattacttttggt

SEQ ID NO: 5512 - DNA, 28 bp, Artificial Sequence
  Synthetic
cagtcatttgggtcggatccgtctgagc

SEQ ID NO: 5513 - DNA, 28 bp, Artificial Sequence
  Synthetic
cagtcatttgggtcacagtgaaccggtc

SEQ ID NO: 5514 - DNA, 28 bp, Artificial Sequence
  Synthetic
cagtcatttgggtcacagtgaaccggtc

SEQ ID NO: 5515 - DNA, 28 bp, Artificial Sequence
  Synthetic
cagtcatttgggctttttgcggtctggg

SEQ ID NO: 5516 - DNA, 28 bp, Artificial Sequence
  Synthetic
cagtcatttgggcagtgcaatgttaaaa

SEQ ID NO: 5517 - DNA, 28 bp, Artificial Sequence
  Synthetic
cagtcatttgggcagtgcaatgatgaaa

SEQ ID NO: 5518 - DNA, 28 bp, Artificial Sequence
  Synthetic
cagtcatttgggtaacagtctacagcca

SEQ ID NO: 5519 - DNA, 28 bp, Artificial Sequence
  Synthetic
cagtcatttgggttggtccccttcaacc

SEQ ID NO: 5520 - DNA, 28 bp, Artificial Sequence
  Synthetic
cagtcatttgggttggtccccttcaacc

SEQ ID NO: 5521 - DNA, 28 bp, Artificial Sequence
  Synthetic
cagtcatttgggtgtgactggttgacca

SEQ ID NO: 5522 - DNA, 28 bp, Artificial Sequence
  Synthetic
cagtcatttgggtatggctttttattcc

SEQ ID NO: 5523 - DNA, 28 bp, Artificial Sequence
  Synthetic
cagtcatttgggtatggcttttcattcc

SEQ ID NO: 5524 - DNA, 28 bp, Artificial Sequence
  Synthetic
cagtcatttgggactccatttgttttga

SEQ ID NO: 5525 - DNA, 28 bp, Artificial Sequence
  Synthetic
cagtcatttgggtattgcttaagaatac

SEQ ID NO: 5526 - DNA, 28 bp, Artificial Sequence
  Synthetic
cagtcatttgggagctggtgttgtgaat

SEQ ID NO: 5527 - DNA, 28 bp, Artificial Sequence
  Synthetic
cagtcatttgggtctacagtgcacgtgt

SEQ ID NO: 5528 - DNA, 28 bp, Artificial Sequence
  Synthetic
cagtcatttgggagtggttttaccctat

SEQ ID NO: 5529 - DNA, 28 bp, Artificial Sequence
  Synthetic
cagtcatttgggtaacactgtctggtaa

SEQ ID NO: 5530 - DNA, 28 bp, Artificial Sequence
  Synthetic
cagtcatttgggtgtagtgtttcctact

SEQ ID NO: 5531 - DNA, 28 bp, Artificial Sequence
  Synthetic
cagtcatttgggcataaagtagaaagca

SEQ ID NO: 5532 - DNA, 28 bp, Artificial Sequence
  Synthetic
cagtcatttgggtgagatgaagcactgt

SEQ ID NO: 5533 - DNA, 28 bp, Artificial Sequence
  Synthetic
cagtcatttgggtacagtatagatgatg

SEQ ID NO: 5534 - DNA, 28 bp, Artificial Sequence
  Synthetic
cagtcatttggggtccagttttcccagg

SEQ ID NO: 5535 - DNA, 28 bp, Artificial Sequence
  Synthetic
cagtcatttgggtgagaactgaattcca

SEQ ID NO: 5536 - DNA, 28 bp, Artificial Sequence
  Synthetic
cagtcatttgggtgagaactgaattcca

SEQ ID NO: 5537 - DNA, 28 bp, Artificial Sequence
  Synthetic
cagtcatttggggtgtgtggaaatgctt

SEQ ID NO: 5538 - DNA, 28 bp, Artificial Sequence
  Synthetic
cagtcatttgggtcagtgcactacagaa

SEQ ID NO: 5539 - DNA, 28 bp, Artificial Sequence
  Synthetic
cagtcatttgggtcagtgcatcacagaa

SEQ ID NO: 5540 - DNA, 28 bp, Artificial Sequence
  Synthetic
cagtcatttgggtctggctccgtgtctt

SEQ ID NO: 5541 - DNA, 28 bp, Artificial Sequence
  Synthetic
cagtcatttgggtctcccaacccttgta

SEQ ID NO: 5542 - DNA, 28 bp, Artificial Sequence
  Synthetic
cagtcatttgggactagactgaagctcc

SEQ ID NO: 5543 - DNA, 28 bp, Artificial Sequence
  Synthetic
cagtcatttgggtcagtgcatgacagaa

SEQ ID NO: 5544 - DNA, 28 bp, Artificial Sequence
  Synthetic
cagtcatttgggttgcatagtcacaaaa

SEQ ID NO: 5545 - DNA, 28 bp, Artificial Sequence
  Synthetic
cagtcatttgggtaggttatccgtgttg

SEQ ID NO: 5546 - DNA, 28 bp, Artificial Sequence
  Synthetic
cagtcatttgggaatcatacacggttga

SEQ ID NO: 5547 - DNA, 28 bp, Artificial Sequence
  Synthetic
cagtcatttgggttaatgctaatcgtga

SEQ ID NO: 5548 - DNA, 28 bp, Artificial Sequence
  Synthetic
cagtcatttgggtagcagcacataatgg

SEQ ID NO: 5549 - DNA, 28 bp, Artificial Sequence
  Synthetic
cagtcatttgggtagcagcacatcatgg

SEQ ID NO: 5550 - DNA, 28 bp, Artificial Sequence
  Synthetic
cagtcatttgggtagcagcacgtaaata

SEQ ID NO: 5551 - DNA, 28 bp, Artificial Sequence
  Synthetic
cagtcatttgggactgcagtgaaggcac

SEQ ID NO: 5552 - DNA, 28 bp, Artificial Sequence
  Synthetic
cagtcatttgggcaaagtgcttacagtg

SEQ ID NO: 5553 - DNA, 28 bp, Artificial Sequence
  Synthetic
cagtcatttgggaacattcaacgctgtc

SEQ ID NO: 5554 - DNA, 28 bp, Artificial Sequence
  Synthetic
cagtcatttgggaccatcgaccgttgat

SEQ ID NO: 5555 - DNA, 28 bp, Artificial Sequence
  Synthetic
cagtcatttgggaacattcattgctgtc

SEQ ID NO: 5556 - DNA, 28 bp, Artificial Sequence
  Synthetic
cagtcatttgggaacattcaacctgtcg

SEQ ID NO: 5557 - DNA, 28 bp, Artificial Sequence
  Synthetic
cagtcatttgggaacattcattgttgtc

SEQ ID NO: 5558 - DNA, 28 bp, Artificial Sequence
  Synthetic
cagtcatttgggtttggcaatggtagaa

SEQ ID NO: 5559 - DNA, 28 bp, Artificial Sequence
  Synthetic
cagtcatttgggtggttctagacttgcc

SEQ ID NO: 5560 - DNA, 28 bp, Artificial Sequence
  Synthetic
cagtcatttgggtatggcactggtagaa

SEQ ID NO: 5561 - DNA, 28 bp, Artificial Sequence
  Synthetic
cagtcatttgggtggacggagaactgat

SEQ ID NO: 5562 - DNA, 28 bp, Artificial Sequence
  Synthetic
cagtcatttgggtggagagaaaggcagt

SEQ ID NO: 5563 - DNA, 28 bp, Artificial Sequence
  Synthetic
cagtcatttgggcaaagaattctccttt

SEQ ID NO: 5564 - DNA, 28 bp, Artificial Sequence
  Synthetic
cagtcatttgggtcgtgtcttgtgttgc

SEQ ID NO: 5565 - DNA, 28 bp, Artificial Sequence
  Synthetic
cagtcatttgggcatcccttgcatggtg

SEQ ID NO: 5566 - DNA, 28 bp, Artificial Sequence
  Synthetic
cagtcatttggggtgcctactgagctga

SEQ ID NO: 5567 - DNA, 28 bp, Artificial Sequence
  Synthetic
cagtcatttgggtaaggtgcatctagtg

SEQ ID NO: 5568 - DNA, 28 bp, Artificial Sequence
  Synthetic
cagtcatttgggactgccctaagtgctc

SEQ ID NO: 5569 - DNA, 28 bp, Artificial Sequence
  Synthetic
cagtcatttgggtaaggtgcatctagtg

SEQ ID NO: 5570 - DNA, 28 bp, Artificial Sequence
  Synthetic
cagtcatttgggtgatatgtttgatata

SEQ ID NO: 5571 - DNA, 28 bp, Artificial Sequence
  Synthetic
cagtcatttgggcaacggaatcccaaaa

SEQ ID NO: 5572 - DNA, 28 bp, Artificial Sequence
  Synthetic
cagtcatttggggctgcgcttggatttc

SEQ ID NO: 5573 - DNA, 28 bp, Artificial Sequence
  Synthetic
cagtcatttgggctgacctatgaattga

SEQ ID NO: 5574 - DNA, 28 bp, Artificial Sequence
  Synthetic
cagtcatttgggaactggcctacaaagt

SEQ ID NO: 5575 - DNA, 28 bp, Artificial Sequence
  Synthetic
cagtcatttgggaactggccctcaaagt

SEQ ID NO: 5576 - DNA, 28 bp, Artificial Sequence
  Synthetic
cagtcatttgggtgtaacagcaactcca

SEQ ID NO: 5577 - DNA, 28 bp, Artificial Sequence
  Synthetic
cagtcatttgggtagcagcacagaaata

SEQ ID NO: 5578 - DNA, 28 bp, Artificial Sequence
  Synthetic
cagtcatttgggtaggtagtttcatgtt

SEQ ID NO: 5579 - DNA, 28 bp, Artificial Sequence
  Synthetic
cagtcatttgggtaggtagtttcctgtt

SEQ ID NO: 5580 - DNA, 28 bp, Artificial Sequence
  Synthetic
cagtcatttgggttcaccaccttctcca

SEQ ID NO: 5581 - DNA, 28 bp, Artificial Sequence
  Synthetic
cagtcatttgggggtccagaggggagat

SEQ ID NO: 5582 - DNA, 28 bp, Artificial Sequence
  Synthetic
cagtcatttgggcccagtgttcagacta

SEQ ID NO: 5583 - DNA, 28 bp, Artificial Sequence
  Synthetic
cagtcatttgggtacagtagtctgcaca

SEQ ID NO: 5584 - DNA, 28 bp, Artificial Sequence
  Synthetic
cagtcatttgggcccagtgtttagacta

SEQ ID NO: 5585 - DNA, 28 bp, Artificial Sequence
  Synthetic
cagtcatttgggtgtgcaaatctatgca

SEQ ID NO: 5586 - DNA, 28 bp, Artificial Sequence
  Synthetic
cagtcatttgggtgtgcaaatccatgca

SEQ ID NO: 5587 - DNA, 28 bp, Artificial Sequence
  Synthetic
cagtcatttgggtaacactgtctggtaa

SEQ ID NO: 5588 - DNA, 28 bp, Artificial Sequence
  Synthetic
cagtcatttgggcatcttaccggacagt

SEQ ID NO: 5589 - DNA, 28 bp, Artificial Sequence
  Synthetic
cagtcatttgggtaatactgcctggtaa

SEQ ID NO: 5590 - DNA, 28 bp, Artificial Sequence
  Synthetic
cagtcatttgggtaatactgccgggtaa

SEQ ID NO: 5591 - DNA, 28 bp, Artificial Sequence
  Synthetic
cagtcatttgggagaggtatagggcatg

SEQ ID NO: 5592 - DNA, 28 bp, Artificial Sequence
  Synthetic
cagtcatttgggtttcctatgcatatac

SEQ ID NO: 5593 - DNA, 28 bp, Artificial Sequence
  Synthetic
cagtcatttggggtgaaatgtttaggac

SEQ ID NO: 5594 - DNA, 28 bp, Artificial Sequence
  Synthetic
cagtcatttgggttccctttgtcatcct

SEQ ID NO: 5595 - DNA, 28 bp, Artificial Sequence
  Synthetic
cagtcatttgggtccttcattccaccgg

SEQ ID NO: 5596 - DNA, 28 bp, Artificial Sequence
  Synthetic
cagtcatttgggtggaatgtaaggaagt

SEQ ID NO: 5597 - DNA, 28 bp, Artificial Sequence
  Synthetic
cagtcatttgggataagacgagcaaaaa

SEQ ID NO: 5598 - DNA, 28 bp, Artificial Sequence
  Synthetic
cagtcatttgggtaaagtgcttatagtg

SEQ ID NO: 5599 - DNA, 28 bp, Artificial Sequence
  Synthetic
cagtcatttgggcaaagtgctcatagtg

SEQ ID NO: 5600 - DNA, 28 bp, Artificial Sequence
  Synthetic
cagtcatttgggtagcttatcagactga

SEQ ID NO: 5601 - DNA, 28 bp, Artificial Sequence
  Synthetic
cagtcatttgggctgtgcgtgtgacagc

SEQ ID NO: 5602 - DNA, 28 bp, Artificial Sequence
  Synthetic
cagtcatttgggttccctttgtcatcct

SEQ ID NO: 5603 - DNA, 28 bp, Artificial Sequence
  Synthetic
cagtcatttgggtaacagtctccagtca

SEQ ID NO: 5604 - DNA, 28 bp, Artificial Sequence
  Synthetic
cagtcatttgggacagcaggcacagaca

SEQ ID NO: 5605 - DNA, 28 bp, Artificial Sequence
  Synthetic
cagtcatttgggatgacctatgaattga

SEQ ID NO: 5606 - DNA, 28 bp, Artificial Sequence
  Synthetic
cagtcatttgggtaatctcagctggcaa

SEQ ID NO: 5607 - DNA, 28 bp, Artificial Sequence
  Synthetic
cagtcatttgggtactgcatcaggaact

SEQ ID NO: 5608 - DNA, 28 bp, Artificial Sequence
  Synthetic
cagtcatttgggttgtgcttgatctaac

SEQ ID NO: 5609 - DNA, 28 bp, Artificial Sequence
  Synthetic
cagtcatttgggtgattgtccaaacgca

SEQ ID NO: 5610 - DNA, 28 bp, Artificial Sequence
  Synthetic
cagtcatttgggaagctgccagttgaag

SEQ ID NO: 5611 - DNA, 28 bp, Artificial Sequence
  Synthetic
cagtcatttgggccacaccgtatctgac

SEQ ID NO: 5612 - DNA, 28 bp, Artificial Sequence
  Synthetic
cagtcatttgggagctacattgtctgct

SEQ ID NO: 5613 - DNA, 28 bp, Artificial Sequence
  Synthetic
cagtcatttgggagctacatctggctac

SEQ ID NO: 5614 - DNA, 28 bp, Artificial Sequence
  Synthetic
cagtcatttgggtgtcagtttgtcaaat

SEQ ID NO: 5615 - DNA, 28 bp, Artificial Sequence
  Synthetic
cagtcatttgggcaagtcactagtggtt

SEQ ID NO: 5616 - DNA, 28 bp, Artificial Sequence
  Synthetic
cagtcatttgggatcacattgccaggga

SEQ ID NO: 5617 - DNA, 28 bp, Artificial Sequence
  Synthetic
cagtcatttgggatcacattgccaggga

SEQ ID NO: 5618 - DNA, 28 bp, Artificial Sequence
  Synthetic
cagtcatttgggtggctcagttcagcag

SEQ ID NO: 5619 - DNA, 28 bp, Artificial Sequence
  Synthetic
cagtcatttgggcattgcacttgtctcg

SEQ ID NO: 5620 - DNA, 28 bp, Artificial Sequence
  Synthetic
cagtcatttgggttcaagtaatccagga

SEQ ID NO: 5621 - DNA, 28 bp, Artificial Sequence
  Synthetic
cagtcatttgggttcaagtaattcagga

SEQ ID NO: 5622 - DNA, 28 bp, Artificial Sequence
  Synthetic
cagtcatttgggttcacagtggctaagt

SEQ ID NO: 5623 - DNA, 28 bp, Artificial Sequence
  Synthetic
cagtcatttgggttcacagtggctaagt

SEQ ID NO: 5624 - DNA, 28 bp, Artificial Sequence
  Synthetic
cagtcatttgggaaggagctcacagtct

SEQ ID NO: 5625 - DNA, 28 bp, Artificial Sequence
  Synthetic
cagtcatttgggagggccccccctcaat

SEQ ID NO: 5626 - DNA, 28 bp, Artificial Sequence
  Synthetic
cagtcatttgggtatgtgggatggtaaa

SEQ ID NO: 5627 - DNA, 28 bp, Artificial Sequence
  Synthetic
cagtcatttgggtggtttaccgtcccac

SEQ ID NO: 5628 - DNA, 28 bp, Artificial Sequence
  Synthetic
cagtcatttgggtagcaccatctgaaat

SEQ ID NO: 5629 - DNA, 28 bp, Artificial Sequence
  Synthetic
cagtcatttgggtagcaccatttgaaat

SEQ ID NO: 5630 - DNA, 28 bp, Artificial Sequence
  Synthetic
cagtcatttgggtagcaccatttgaaat

SEQ ID NO: 5631 - DNA, 28 bp, Artificial Sequence
  Synthetic
cagtcatttgggcagtgcaatagtattg

SEQ ID NO: 5632 - DNA, 28 bp, Artificial Sequence
  Synthetic
cagtcatttgggtaagtgcttccatgtt

SEQ ID NO: 5633 - DNA, 28 bp, Artificial Sequence
  Synthetic
cagtcatttgggtaaacgtggatgtact

SEQ ID NO: 5634 - DNA, 28 bp, Artificial Sequence
  Synthetic
cagtcatttgggtaagtgcttccatgtt

SEQ ID NO: 5635 - DNA, 28 bp, Artificial Sequence
  Synthetic
cagtcatttgggactttaacatggaagt

SEQ ID NO: 5636 - DNA, 28 bp, Artificial Sequence
  Synthetic
cagtcatttgggtaagtgcttccatgtt

SEQ ID NO: 5637 - DNA, 28 bp, Artificial Sequence
  Synthetic
cagtcatttgggtttaacatgggggtac

SEQ ID NO: 5638 - DNA, 28 bp, Artificial Sequence
  Synthetic
cagtcatttgggtaagtgcttccatgtt

SEQ ID NO: 5639 - DNA, 28 bp, Artificial Sequence
  Synthetic
cagtcatttgggctttcagtcggatgtt

SEQ ID NO: 5640 - DNA, 28 bp, Artificial Sequence
  Synthetic
cagtcatttgggtgtaaacatcctcgac

SEQ ID NO: 5641 - DNA, 28 bp, Artificial Sequence
  Synthetic
cagtcatttgggtgtaaacatcctacac

SEQ ID NO: 5642 - DNA, 28 bp, Artificial Sequence
  Synthetic
cagtcatttgggtgtaaacatcctacac

SEQ ID NO: 5643 - DNA, 28 bp, Artificial Sequence
  Synthetic
cagtcatttgggtgtaaacatccccgac

SEQ ID NO: 5644 - DNA, 28 bp, Artificial Sequence
  Synthetic
cagtcatttgggctttcagtcggatgtt

SEQ ID NO: 5645 - DNA, 28 bp, Artificial Sequence
  Synthetic
cagtcatttgggtgtaaacatccttgac

SEQ ID NO: 5646 - DNA, 28 bp, Artificial Sequence
  Synthetic
cagtcatttgggggcaagatgctggcat

SEQ ID NO: 5647 - DNA, 28 bp, Artificial Sequence
  Synthetic
cagtcatttgggtattgcacattactaa

SEQ ID NO: 5648 - DNA, 28 bp, Artificial Sequence
  Synthetic
cagtcatttgggaaaagctgggttgaga

SEQ ID NO: 5649 - DNA, 28 bp, Artificial Sequence
  Synthetic
cagtcatttggggcacattacacggtcg

SEQ ID NO: 5650 - DNA, 28 bp, Artificial Sequence
  Synthetic
cagtcatttgggccactgccccaggtgc

SEQ ID NO: 5651 - DNA, 28 bp, Artificial Sequence
  Synthetic
cagtcatttgggcgcatcccctagggca

SEQ ID NO: 5652 - DNA, 28 bp, Artificial Sequence
  Synthetic
cagtcatttgggcctagtaggtgtccag

SEQ ID NO: 5653 - DNA, 28 bp, Artificial Sequence
  Synthetic
cagtcatttgggcctctgggcccttcct

SEQ ID NO: 5654 - DNA, 28 bp, Artificial Sequence
  Synthetic
cagtcatttgggctggccctctctgccc

SEQ ID NO: 5655 - DNA, 28 bp, Artificial Sequence
  Synthetic
cagtcatttgggaacacacctggttaac

SEQ ID NO: 5656 - DNA, 28 bp, Artificial Sequence
  Synthetic
cagtcatttggggtgcattgtagttgca

SEQ ID NO: 5657 - DNA, 28 bp, Artificial Sequence
  Synthetic
cagtcatttggggcaaagcacacggcct

SEQ ID NO: 5658 - DNA, 28 bp, Artificial Sequence
  Synthetic
cagtcatttggggcccctgggcctatcc

SEQ ID NO: 5659 - DNA, 28 bp, Artificial Sequence
  Synthetic
cagtcatttgggtcaagagcaataacga

SEQ ID NO: 5660 - DNA, 28 bp, Artificial Sequence
  Synthetic
cagtcatttgggtccagctcctatatga

SEQ ID NO: 5661 - DNA, 28 bp, Artificial Sequence
  Synthetic
cagtcatttgggtccagcatcagtgatt

SEQ ID NO: 5662 - DNA, 28 bp, Artificial Sequence
  Synthetic
cagtcatttgggtccctgtcctccagga

SEQ ID NO: 5663 - DNA, 28 bp, Artificial Sequence
  Synthetic
cagtcatttggggtgcattgctgttgca

SEQ ID NO: 5664 - DNA, 28 bp, Artificial Sequence
  Synthetic
cagtcatttgggtccgtctcagttactt

SEQ ID NO: 5665 - DNA, 28 bp, Artificial Sequence
  Synthetic
cagtcatttgggtctcacacagaaatcg

SEQ ID NO: 5666 - DNA, 28 bp, Artificial Sequence
  Synthetic
cagtcatttgggtgctgactcctagtcc

SEQ ID NO: 5667 - DNA, 28 bp, Artificial Sequence
  Synthetic
cagtcatttgggtgtctgcccgcatgcc

SEQ ID NO: 5668 - DNA, 28 bp, Artificial Sequence
  Synthetic
cagtcatttgggtggcagtgtcttagct

SEQ ID NO: 5669 - DNA, 28 bp, Artificial Sequence
  Synthetic
cagtcatttgggtaggcagtgtcattag

SEQ ID NO: 5670 - DNA, 28 bp, Artificial Sequence
  Synthetic
cagtcatttgggaggcagtgtagttagc

SEQ ID NO: 5671 - DNA, 28 bp, Artificial Sequence
  Synthetic
cagtcatttgggttatcagaatctccag

SEQ ID NO: 5672 - DNA, 28 bp, Artificial Sequence
  Synthetic
cagtcatttgggaatccttggaacctag

SEQ ID NO: 5673 - DNA, 28 bp, Artificial Sequence
  Synthetic
cagtcatttgggaattgcacggtatcca

SEQ ID NO: 5674 - DNA, 28 bp, Artificial Sequence
  Synthetic
cagtcatttgggcgggtggatcacgatg

SEQ ID NO: 5675 - DNA, 28 bp, Artificial Sequence
  Synthetic
cagtcatttgggtaatgcccctaaaaat

SEQ ID NO: 5676 - DNA, 28 bp, Artificial Sequence
  Synthetic
cagtcatttgggaattgcactttagcaa

SEQ ID NO: 5677 - DNA, 28 bp, Artificial Sequence
  Synthetic
cagtcatttgggacatagaggaaattcc

SEQ ID NO: 5678 - DNA, 28 bp, Artificial Sequence
  Synthetic
cagtcatttgggaataatacatggttga

SEQ ID NO: 5679 - DNA, 28 bp, Artificial Sequence
  Synthetic
cagtcatttgggagatcgaccgtgttat

SEQ ID NO: 5680 - DNA, 28 bp, Artificial Sequence
  Synthetic
cagtcatttggggcctgctggggtggaa

SEQ ID NO: 5681 - DNA, 28 bp, Artificial Sequence
  Synthetic
cagtcatttggggtgccgccatcttttg

SEQ ID NO: 5682 - DNA, 28 bp, Artificial Sequence
  Synthetic
cagtcatttgggaaagtgctgcgacatt

SEQ ID NO: 5683 - DNA, 28 bp, Artificial Sequence
  Synthetic
cagtcatttggggaagtgcttcgatttt

SEQ ID NO: 5684 - DNA, 28 bp, Artificial Sequence
  Synthetic
cagtcatttgggactcaaaatgggggcg

SEQ ID NO: 5685 - DNA, 28 bp, Artificial Sequence
  Synthetic
cagtcatttgggttataatacaacctga

SEQ ID NO: 5686 - DNA, 28 bp, Artificial Sequence
  Synthetic
cagtcatttgggtttgttcgttcggctc

SEQ ID NO: 5687 - DNA, 28 bp, Artificial Sequence
  Synthetic
cagtcatttgggatcatagaggaaaatc

SEQ ID NO: 5688 - DNA, 28 bp, Artificial Sequence
  Synthetic
cagtcatttgggggtagattctccttct

SEQ ID NO: 5689 - DNA, 28 bp, Artificial Sequence
  Synthetic
cagtcatttgggatcatagaggaaaatc

SEQ ID NO: 5690 - DNA, 28 bp, Artificial Sequence
  Synthetic
cagtcatttgggatcacacaaaggcaac

SEQ ID NO: 5691 - DNA, 28 bp, Artificial Sequence
  Synthetic
cagtcatttgggctcctgactccaggtc

SEQ ID NO: 5692 - DNA, 28 bp, Artificial Sequence
  Synthetic
cagtcatttgggtggtagactatggaac

SEQ ID NO: 5693 - DNA, 28 bp, Artificial Sequence
  Synthetic
cagtcatttgggtatgtaatatggtcca

SEQ ID NO: 5694 - DNA, 28 bp, Artificial Sequence
  Synthetic
cagtcatttgggtggttgaccatagaac

SEQ ID NO: 5695 - DNA, 28 bp, Artificial Sequence
  Synthetic
cagtcatttgggtatacaagggcaagct

SEQ ID NO: 5696 - DNA, 28 bp, Artificial Sequence
  Synthetic
cagtcatttggggaagttgttcgtggtg

SEQ ID NO: 5697 - DNA, 28 bp, Artificial Sequence
  Synthetic
cagtcatttgggagatcagaaggtgatt

SEQ ID NO: 5698 - DNA, 28 bp, Artificial Sequence
  Synthetic
cagtcatttgggattcctagaaattgtt

SEQ ID NO: 5699 - DNA, 28 bp, Artificial Sequence
  Synthetic
cagtcatttgggcgaatgttgctcggtg

SEQ ID NO: 5700 - DNA, 28 bp, Artificial Sequence
  Synthetic
cagtcatttgggaggttacccgagcaac

SEQ ID NO: 5701 - DNA, 28 bp, Artificial Sequence
  Synthetic
cagtcatttgggaatataacacagatgg

SEQ ID NO: 5702 - DNA, 28 bp, Artificial Sequence
  Synthetic
cagtcatttgggtagtagaccgtatagc

SEQ ID NO: 5703 - DNA, 28 bp, Artificial Sequence
  Synthetic
cagtcatttgggacttcacctggtccac

SEQ ID NO: 5704 - DNA, 28 bp, Artificial Sequence
  Synthetic
cagtcatttgggatcaacagacattaat

SEQ ID NO: 5705 - DNA, 28 bp, Artificial Sequence
  Synthetic
cagtcatttgggctggacttagggtcag

SEQ ID NO: 5706 - DNA, 28 bp, Artificial Sequence
  Synthetic
cagtcatttgggctggacttggagtcag

SEQ ID NO: 5707 - DNA, 28 bp, Artificial Sequence
  Synthetic
cagtcatttgggagctcggtctgaggcc

SEQ ID NO: 5708 - DNA, 28 bp, Artificial Sequence
  Synthetic
cagtcatttgggcagcagcaattcatgt

SEQ ID NO: 5709 - DNA, 28 bp, Artificial Sequence
  Synthetic
cagtcatttgggatcgggaatgtcgtgt

SEQ ID NO: 5710 - DNA, 28 bp, Artificial Sequence
  Synthetic
cagtcatttgggaatgacacgatcactc

SEQ ID NO: 5711 - DNA, 28 bp, Artificial Sequence
  Synthetic
cagtcatttgggtaatactgtctggtaa

SEQ ID NO: 5712 - DNA, 28 bp, Artificial Sequence
  Synthetic
cagtcatttgggtgtcttgcaggccgtc

SEQ ID NO: 5713 - DNA, 28 bp, Artificial Sequence
  Synthetic
cagtcatttgggtcttggagtaggtcat

SEQ ID NO: 5714 - DNA, 28 bp, Artificial Sequence
  Synthetic
cagtcatttgggctggatggctcctcca

SEQ ID NO: 5715 - DNA, 28 bp, Artificial Sequence
  Synthetic
cagtcatttgggatcatgatgggctcct

SEQ ID NO: 5716 - DNA, 28 bp, Artificial Sequence
  Synthetic
cagtcatttgggttgcatatgtaggatg

SEQ ID NO: 5717 - DNA, 28 bp, Artificial Sequence
  Synthetic
cagtcatttgggtggcagtgtattgtta

SEQ ID NO: 5718 - DNA, 28 bp, Artificial Sequence
  Synthetic
cagtcatttgggaggcagtgtattgtta

SEQ ID NO: 5719 - DNA, 28 bp, Artificial Sequence
  Synthetic
cagtcatttgggtttttgcgatgtgttc

SEQ ID NO: 5720 - DNA, 28 bp, Artificial Sequence
  Synthetic
cagtcatttgggaaaccgttaccattac

SEQ ID NO: 5721 - DNA, 28 bp, Artificial Sequence
  Synthetic
cagtcatttgggtgtttgcagaggaaac

SEQ ID NO: 5722 - DNA, 28 bp, Artificial Sequence
  Synthetic
cagtcatttgggtcagtctcatctgcaa

SEQ ID NO: 5723 - DNA, 28 bp, Artificial Sequence
  Synthetic
cagtcatttggggaggttgtccgtggtg

SEQ ID NO: 5724 - DNA, 28 bp, Artificial Sequence
  Synthetic
cagtcatttgggtagtgcaatattgctt

SEQ ID NO: 5725 - DNA, 28 bp, Artificial Sequence
  Synthetic
cagtcatttgggaccctatcaatattgt

SEQ ID NO: 5726 - DNA, 28 bp, Artificial Sequence
  Synthetic
cagtcatttgggtatgtgcctttggact

SEQ ID NO: 5727 - DNA, 28 bp, Artificial Sequence
  Synthetic
cagtcatttgggtcactcctctcctccc

SEQ ID NO: 5728 - DNA, 28 bp, Artificial Sequence
  Synthetic
cagtcatttgggtcaggctcagtcccct

SEQ ID NO: 5729 - DNA, 28 bp, Artificial Sequence
  Synthetic
cagtcatttggggtcatacacggctctc

SEQ ID NO: 5730 - DNA, 28 bp, Artificial Sequence
  Synthetic
cagtcatttgggagaggctggccgtgat

SEQ ID NO: 5731 - DNA, 28 bp, Artificial Sequence
  Synthetic
cagtcatttgggtcctgtactgagctgc

SEQ ID NO: 5732 - DNA, 28 bp, Artificial Sequence
  Synthetic
cagtcatttgggaatcatacagggacat

SEQ ID NO: 5733 - DNA, 28 bp, Artificial Sequence
  Synthetic
cagtcatttgggaatcgtacagggtcat

SEQ ID NO: 5734 - DNA, 28 bp, Artificial Sequence
  Synthetic
cagtcatttgggcccagataatggcact

SEQ ID NO: 5735 - DNA, 28 bp, Artificial Sequence
  Synthetic
cagtcatttgggagtgacatcacatata

SEQ ID NO: 5736 - DNA, 28 bp, Artificial Sequence
  Synthetic
cagtcatttgggcaacctggaggactcc

SEQ ID NO: 5737 - DNA, 28 bp, Artificial Sequence
  Synthetic
cagtcatttgggagtggggaacccttcc

SEQ ID NO: 5738 - DNA, 28 bp, Artificial Sequence
  Synthetic
cagtcatttgggaggacctgcgggacaa

SEQ ID NO: 5739 - DNA, 28 bp, Artificial Sequence
  Synthetic
cagtcatttgggtgaaggtctactgtgt

SEQ ID NO: 5740 - DNA, 28 bp, Artificial Sequence
  Synthetic
cagtcatttgggttgtacatggtaggct

SEQ ID NO: 5741 - DNA, 28 bp, Artificial Sequence
  Synthetic
cagtcatttgggtgaaacatacacggga

SEQ ID NO: 5742 - DNA, 28 bp, Artificial Sequence
  Synthetic
cagtcatttgggaaacaaacatggtgca

SEQ ID NO: 5743 - DNA, 28 bp, Artificial Sequence
  Synthetic
cagtcatttgggattacatggccaatct

SEQ ID NO: 5744 - DNA, 28 bp, Artificial Sequence
  Synthetic
cagtcatttgggcagcagcacactgtgg

SEQ ID NO: 5745 - DNA, 28 bp, Artificial Sequence
  Synthetic
cagtcatttgggtttcaagccagggggc

SEQ ID NO: 5746 - DNA, 28 bp, Artificial Sequence
  Synthetic
cagtcatttgggttaagacttgcagtga

SEQ ID NO: 5747 - DNA, 28 bp, Artificial Sequence
  Synthetic
cagtcatttgggatgcacctgggcaagg

SEQ ID NO: 5748 - DNA, 28 bp, Artificial Sequence
  Synthetic
cagtcatttgggaatcctttgtccctgg

SEQ ID NO: 5749 - DNA, 28 bp, Artificial Sequence
  Synthetic
cagtcatttgggatccttgctatctggg

SEQ ID NO: 5750 - DNA, 28 bp, Artificial Sequence
  Synthetic
cagtcatttgggtagcagcgggaacagt

SEQ ID NO: 5751 - DNA, 28 bp, Artificial Sequence
  Synthetic
cagtcatttgggagaccctggtctgcac

SEQ ID NO: 5752 - DNA, 28 bp, Artificial Sequence
  Synthetic
cagtcatttggggtcaacacttgctggt

SEQ ID NO: 5753 - DNA, 28 bp, Artificial Sequence
  Synthetic
cagtcatttgggtaaggcacccttctga

SEQ ID NO: 5754 - DNA, 28 bp, Artificial Sequence
  Synthetic
cagtcatttgggttttgcaccttttgga

SEQ ID NO: 5755 - DNA, 28 bp, Artificial Sequence
  Synthetic
cagtcatttgggtgattgtagccttttg

SEQ ID NO: 5756 - DNA, 28 bp, Artificial Sequence
  Synthetic
cagtcatttgggtgattggtacgtctgt

SEQ ID NO: 5757 - DNA, 28 bp, Artificial Sequence
  Synthetic
cagtcatttgggtactcaggagagtggc

SEQ ID NO: 5758 - DNA, 28 bp, Artificial Sequence
  Synthetic
cagtcatttggggtgtcttttgctctgc

SEQ ID NO: 5759 - DNA, 28 bp, Artificial Sequence
  Synthetic
cagtcatttgggaagtgctgtcatagct

SEQ ID NO: 5760 - DNA, 28 bp, Artificial Sequence
  Synthetic
cagtcatttgggcactcagccttgaggg

SEQ ID NO: 5761 - DNA, 28 bp, Artificial Sequence
  Synthetic
cagtcatttgggttcacagggaggtgtc

SEQ ID NO: 5762 - DNA, 28 bp, Artificial Sequence
  Synthetic
cagtcatttgggattgacacttctgtga

SEQ ID NO: 5763 - DNA, 28 bp, Artificial Sequence
  Synthetic
cagtcatttggggagtgccttcttttgg

SEQ ID NO: 5764 - DNA, 28 bp, Artificial Sequence
  Synthetic
cagtcatttgggttctccaaaagaaagc

SEQ ID NO: 5765 - DNA, 28 bp, Artificial Sequence
  Synthetic
cagtcatttgggtgcttcctttcagagg

SEQ ID NO: 5766 - DNA, 28 bp, Artificial Sequence
  Synthetic
cagtcatttgggcatctggaggtaagaa

SEQ ID NO: 5767 - DNA, 28 bp, Artificial Sequence
  Synthetic
cagtcatttgggcctctagatggaagca

SEQ ID NO: 5768 - DNA, 28 bp, Artificial Sequence
  Synthetic
cagtcatttgggatcgtgcatcccttta

SEQ ID NO: 5769 - DNA, 28 bp, Artificial Sequence
  Synthetic
cagtcatttgggtcgtgcatccctttag

SEQ ID NO: 5770 - DNA, 28 bp, Artificial Sequence
  Synthetic
cagtcatttgggatcgtgcatcctttta

SEQ ID NO: 5771 - DNA, 28 bp, Artificial Sequence
  Synthetic
cagtcatttgggaaagcgcttccctttg

SEQ ID NO: 5772 - DNA, 28 bp, Artificial Sequence
  Synthetic
cagtcatttgggcaaagcgctccccttt

SEQ ID NO: 5773 - DNA, 28 bp, Artificial Sequence
  Synthetic
cagtcatttgggcaaagcgcttctcttt

SEQ ID NO: 5774 - DNA, 28 bp, Artificial Sequence
  Synthetic
cagtcatttgggtctctggagggaagca

SEQ ID NO: 5775 - DNA, 28 bp, Artificial Sequence
  Synthetic
cagtcatttgggcaaagcgcttcccttt

SEQ ID NO: 5776 - DNA, 28 bp, Artificial Sequence
  Synthetic
cagtcatttgggaaagcgcttcccttca

SEQ ID NO: 5777 - DNA, 28 bp, Artificial Sequence
  Synthetic
cagtcatttgggaaagcgcttctcttta

SEQ ID NO: 5778 - DNA, 28 bp, Artificial Sequence
  Synthetic
cagtcatttgggctctagagggaagcac

SEQ ID NO: 5779 - DNA, 28 bp, Artificial Sequence
  Synthetic
cagtcatttgggaaagtgcatcctttta

SEQ ID NO: 5780 - DNA, 28 bp, Artificial Sequence
  Synthetic
cagtcatttgggaaagtgcatcctttta

SEQ ID NO: 5781 - DNA, 28 bp, Artificial Sequence
  Synthetic
cagtcatttgggaaagtgcatcttttta

SEQ ID NO: 5782 - DNA, 28 bp, Artificial Sequence
  Synthetic
cagtcatttgggcaaagtgcctcccttt

SEQ ID NO: 5783 - DNA, 28 bp, Artificial Sequence
  Synthetic
cagtcatttgggaaagtgcctcctttta

SEQ ID NO: 5784 - DNA, 28 bp, Artificial Sequence
  Synthetic
cagtcatttgggttctccaaaagggagc

SEQ ID NO: 5785 - DNA, 28 bp, Artificial Sequence
  Synthetic
cagtcatttgggaaagtgcttccctttg

SEQ ID NO: 5786 - DNA, 28 bp, Artificial Sequence
  Synthetic
cagtcatttgggctccagagggaagtac

SEQ ID NO: 5787 - DNA, 28 bp, Artificial Sequence
  Synthetic
cagtcatttgggaaagtgcttcctttta

SEQ ID NO: 5788 - DNA, 28 bp, Artificial Sequence
  Synthetic
cagtcatttgggaaagtgcttcctttta

SEQ ID NO: 5789 - DNA, 28 bp, Artificial Sequence
  Synthetic
cagtcatttgggaaagtgcttctctttg

SEQ ID NO: 5790 - DNA, 28 bp, Artificial Sequence
  Synthetic
cagtcatttgggtctacaaagggaagcc

SEQ ID NO: 5791 - DNA, 28 bp, Artificial Sequence
  Synthetic
cagtcatttgggaaagtgcttccttttt

SEQ ID NO: 5792 - DNA, 28 bp, Artificial Sequence
  Synthetic
cagtcatttgggaagtgcttccttttag

SEQ ID NO: 5793 - DNA, 28 bp, Artificial Sequence
  Synthetic
cagtcatttgggacaaagtgcttccctt

SEQ ID NO: 5794 - DNA, 28 bp, Artificial Sequence
  Synthetic
cagtcatttgggacaaagtgcttccctt

SEQ ID NO: 5795 - DNA, 28 bp, Artificial Sequence
  Synthetic
cagtcatttgggaacgcacttcccttta

SEQ ID NO: 5796 - DNA, 28 bp, Artificial Sequence
  Synthetic
cagtcatttgggaaaatggttcccttta

SEQ ID NO: 5797 - DNA, 28 bp, Artificial Sequence
  Synthetic
cagtcatttgggaacgcgcttccctata

SEQ ID NO: 5798 - DNA, 28 bp, Artificial Sequence
  Synthetic
cagtcatttggggaaggcgcttcccttt

SEQ ID NO: 5799 - DNA, 28 bp, Artificial Sequence
  Synthetic
cagtcatttgggctacaaagggaagcac

SEQ ID NO: 5800 - DNA, 28 bp, Artificial Sequence
  Synthetic
cagtcatttgggctccagagggatgcac

SEQ ID NO: 5801 - DNA, 28 bp, Artificial Sequence
  Synthetic
cagtcatttggggaaggcgcttcccttt

SEQ ID NO: 5802 - DNA, 28 bp, Artificial Sequence
  Synthetic
cagtcatttgggctctagagggaagcac

SEQ ID NO: 5803 - DNA, 28 bp, Artificial Sequence
  Synthetic
cagtcatttgggctcttgagggaagcac

SEQ ID NO: 5804 - DNA, 28 bp, Artificial Sequence
  Synthetic
cagtcatttgggaaagtgcttcctttta

SEQ ID NO: 5805 - DNA, 28 bp, Artificial Sequence
  Synthetic
cagtcatttgggctctagagggaagcgc

SEQ ID NO: 5806 - DNA, 28 bp, Artificial Sequence
  Synthetic
cagtcatttgggctgcaaagggaagccc

SEQ ID NO: 5807 - DNA, 28 bp, Artificial Sequence
  Synthetic
cagtcatttgggcatgccttgagtgtag

SEQ ID NO: 5808 - DNA, 28 bp, Artificial Sequence
  Synthetic
cagtcatttgggggagaaattatccttg

SEQ ID NO: 5809 - DNA, 28 bp, Artificial Sequence
  Synthetic
cagtcatttgggtgtgacagattgataa

SEQ ID NO: 5810 - DNA, 28 bp, Artificial Sequence
  Synthetic
cagtcatttgggtcggggatcatcatgt

SEQ ID NO: 5811 - DNA, 28 bp, Artificial Sequence
  Synthetic
cagtcatttgggattctgcatttttagc

SEQ ID NO: 5812 - DNA, 28 bp, Artificial Sequence
  Synthetic
cagtcatttgggatcagcaaacatttat

SEQ ID NO: 5813 - DNA, 28 bp, Artificial Sequence
  Synthetic
cagtcatttgggcaaaactggcaattac

SEQ ID NO: 5814 - DNA, 28 bp, Artificial Sequence
  Synthetic
cagtcatttgggcaagaacctcagttgc

SEQ ID NO: 5815 - DNA, 28 bp, Artificial Sequence
  Synthetic
cagtcatttgggcaaaaatctcaattac

SEQ ID NO: 5816 - DNA, 28 bp, Artificial Sequence
  Synthetic
cagtcatttgggcaaaaaccacagtttc

SEQ ID NO: 5817 - DNA, 28 bp, Artificial Sequence
  Synthetic
cagtcatttgggtgacaactatggatga

SEQ ID NO: 5818 - DNA, 28 bp, Artificial Sequence
  Synthetic
cagtcatttgggtgtcttactccctcag

SEQ ID NO: 5819 - DNA, 28 bp, Artificial Sequence
  Synthetic
cagtcatttggggcgacccactcttggt

SEQ ID NO: 5820 - DNA, 28 bp, Artificial Sequence
  Synthetic
cagtcatttggggcgacccatacttggt

SEQ ID NO: 5821 - DNA, 28 bp, Artificial Sequence
  Synthetic
cagtcatttgggaacaggtgactggtta

SEQ ID NO: 5822 - DNA, 28 bp, Artificial Sequence
  Synthetic
cagtcatttgggaaaacggtgagatttt

SEQ ID NO: 5823 - DNA, 28 bp, Artificial Sequence
  Synthetic
cagtcatttggggctagtcctgactcag

SEQ ID NO: 5824 - DNA, 28 bp, Artificial Sequence
  Synthetic
cagtcatttgggagggtaagctgaacct

SEQ ID NO: 5825 - DNA, 28 bp, Artificial Sequence
  Synthetic
cagtcatttggggatgagctcattgtaa

SEQ ID NO: 5826 - DNA, 28 bp, Artificial Sequence
  Synthetic
cagtcatttggggtttgcacgggtgggc

SEQ ID NO: 5827 - DNA, 28 bp, Artificial Sequence
  Synthetic
cagtcatttgggtgagctgctgtaccaa

SEQ ID NO: 5828 - DNA, 28 bp, Artificial Sequence
  Synthetic
cagtcatttgggtaaagtaaatatgcac

SEQ ID NO: 5829 - DNA, 28 bp, Artificial Sequence
  Synthetic
cagtcatttggggcgtgcgccggccggc

SEQ ID NO: 5830 - DNA, 28 bp, Artificial Sequence
  Synthetic
cagtcatttgggcaaagtttaagatcct

SEQ ID NO: 5831 - DNA, 28 bp, Artificial Sequence
  Synthetic
cagtcatttgggaaagtagctgtaccat

SEQ ID NO: 5832 - DNA, 28 bp, Artificial Sequence
  Synthetic
cagtcatttgggaggttgacatacgttt

SEQ ID NO: 5833 - DNA, 28 bp, Artificial Sequence
  Synthetic
cagtcatttgggaggcacggtgtcagca

SEQ ID NO: 5834 - DNA, 28 bp, Artificial Sequence
  Synthetic
cagtcatttgggggctggctcgcgatgt

SEQ ID NO: 5835 - DNA, 28 bp, Artificial Sequence
  Synthetic
cagtcatttggggggcgcctgtgatccc

SEQ ID NO: 5836 - DNA, 28 bp, Artificial Sequence
  Synthetic
cagtcatttgggagtatgttcttccagg

SEQ ID NO: 5837 - DNA, 28 bp, Artificial Sequence
  Synthetic
cagtcatttgggatgtataaatgtatac

SEQ ID NO: 5838 - DNA, 28 bp, Artificial Sequence
  Synthetic
cagtcatttgggagttaatgaatcctgg

SEQ ID NO: 5839 - DNA, 28 bp, Artificial Sequence
  Synthetic
cagtcatttggggaaaacagcaattacc

SEQ ID NO: 5840 - DNA, 28 bp, Artificial Sequence
  Synthetic
cagtcatttgggtgagttggccatctga

SEQ ID NO: 5841 - DNA, 28 bp, Artificial Sequence
  Synthetic
cagtcatttggggtccgctcggcggtgg

SEQ ID NO: 5842 - DNA, 28 bp, Artificial Sequence
  Synthetic
cagtcatttgggctgaagtgatgtgtaa

SEQ ID NO: 5843 - DNA, 28 bp, Artificial Sequence
  Synthetic
cagtcatttgggcacgctcatgcacaca

SEQ ID NO: 5844 - DNA, 28 bp, Artificial Sequence
  Synthetic
cagtcatttggggagccagttggacagg

SEQ ID NO: 5845 - DNA, 28 bp, Artificial Sequence
  Synthetic
cagtcatttgggattctaatttctccac

SEQ ID NO: 5846 - DNA, 28 bp, Artificial Sequence
  Synthetic
cagtcatttgggtagataaaatattggt

SEQ ID NO: 5847 - DNA, 28 bp, Artificial Sequence
  Synthetic
cagtcatttgggcttcttgtgctctagg

SEQ ID NO: 5848 - DNA, 28 bp, Artificial Sequence
  Synthetic
cagtcatttgggattcatttggtataaa

SEQ ID NO: 5849 - DNA, 28 bp, Artificial Sequence
  Synthetic
cagtcatttgggttgagaatgatgaatc

SEQ ID NO: 5850 - DNA, 28 bp, Artificial Sequence
  Synthetic
cagtcatttgggtcttgtgttctctaga

SEQ ID NO: 5851 - DNA, 28 bp, Artificial Sequence
  Synthetic
cagtcatttgggttacagttgttcaacc

SEQ ID NO: 5852 - DNA, 28 bp, Artificial Sequence
  Synthetic
cagtcatttgggcaaagaggaaggtccc

SEQ ID NO: 5853 - DNA, 28 bp, Artificial Sequence
  Synthetic
cagtcatttgggttatggtttgcctggg

SEQ ID NO: 5854 - DNA, 28 bp, Artificial Sequence
  Synthetic
cagtcatttgggtgggcgtatctgtatg

SEQ ID NO: 5855 - DNA, 28 bp, Artificial Sequence
  Synthetic
cagtcatttgggtatgcattgtattttt

SEQ ID NO: 5856 - DNA, 28 bp, Artificial Sequence
  Synthetic
cagtcatttgggtttccataggtgatga

SEQ ID NO: 5857 - DNA, 28 bp, Artificial Sequence
  Synthetic
cagtcatttgggttggccacaatgggtt

SEQ ID NO: 5858 - DNA, 28 bp, Artificial Sequence
  Synthetic
cagtcatttgggtcagaacaaatgccgg

SEQ ID NO: 5859 - DNA, 28 bp, Artificial Sequence
  Synthetic
cagtcatttggggagcttattcataaaa

SEQ ID NO: 5860 - DNA, 28 bp, Artificial Sequence
  Synthetic
cagtcatttgggagaccatgggttctca

SEQ ID NO: 5861 - DNA, 28 bp, Artificial Sequence
  Synthetic
cagtcatttgggttgtgtcaatatgcga

SEQ ID NO: 5862 - DNA, 28 bp, Artificial Sequence
  Synthetic
cagtcatttgggaggcaccagccaggca

SEQ ID NO: 5863 - DNA, 28 bp, Artificial Sequence
  Synthetic
cagtcatttgggcccatctggggtggcc

SEQ ID NO: 5864 - DNA, 28 bp, Artificial Sequence
  Synthetic
cagtcatttggggaagtgtgccgtggtg

SEQ ID NO: 5865 - DNA, 28 bp, Artificial Sequence
  Synthetic
cagtcatttgggaagcctgcccggctcc

SEQ ID NO: 5866 - DNA, 28 bp, Artificial Sequence
  Synthetic
cagtcatttgggtgtgtcactcgatgac

SEQ ID NO: 5867 - DNA, 28 bp, Artificial Sequence
  Synthetic
cagtcatttgggtacgtcatcgttgtca

SEQ ID NO: 5868 - DNA, 28 bp, Artificial Sequence
  Synthetic
cagtcatttggggttgtgtcagtttatc

SEQ ID NO: 5869 - DNA, 28 bp, Artificial Sequence
  Synthetic
cagtcatttgggacttacagacaagagc

SEQ ID NO: 5870 - DNA, 28 bp, Artificial Sequence
  Synthetic
cagtcatttgggtggtctaggattgttg

SEQ ID NO: 5871 - DNA, 28 bp, Artificial Sequence
  Synthetic
cagtcatttggggacacgggcgacagct

SEQ ID NO: 5872 - DNA, 28 bp, Artificial Sequence
  Synthetic
cagtcatttgggcacacactgcaattac

SEQ ID NO: 5873 - DNA, 28 bp, Artificial Sequence
  Synthetic
cagtcatttgggaggctgcggaattcag

SEQ ID NO: 5874 - DNA, 28 bp, Artificial Sequence
  Synthetic
cagtcatttgggtaaatcccatggtgcc

SEQ ID NO: 5875 - DNA, 28 bp, Artificial Sequence
  Synthetic
cagtcatttgggaaactactgaaaatca

SEQ ID NO: 5876 - DNA, 28 bp, Artificial Sequence
  Synthetic
cagtcatttggggttcaaatccagatct

SEQ ID NO: 5877 - DNA, 28 bp, Artificial Sequence
  Synthetic
cagtcatttgggaggggtggtgttggga

SEQ ID NO: 5878 - DNA, 28 bp, Artificial Sequence
  Synthetic
cagtcatttgggagggtgtttctctcat

SEQ ID NO: 5879 - DNA, 28 bp, Artificial Sequence
  Synthetic
cagtcatttgggtgagctaaatgtgtgc

SEQ ID NO: 5880 - DNA, 28 bp, Artificial Sequence
  Synthetic
cagtcatttggggcgaggacccctcggg

SEQ ID NO: 5881 - DNA, 28 bp, Artificial Sequence
  Synthetic
cagtcatttggggctgggcagggcttct

SEQ ID NO: 5882 - DNA, 28 bp, Artificial Sequence
  Synthetic
cagtcatttgggaggaatgttccttctt

SEQ ID NO: 5883 - DNA, 28 bp, Artificial Sequence
  Synthetic
cagtcatttggggaacgcctgttcttgc

SEQ ID NO: 5884 - DNA, 28 bp, Artificial Sequence
  Synthetic
cagtcatttgggtccgagcctgggtctc

SEQ ID NO: 5885 - DNA, 28 bp, Artificial Sequence
  Synthetic
cagtcatttgggactcaaaacccttcag

SEQ ID NO: 5886 - DNA, 28 bp, Artificial Sequence
  Synthetic
cagtcatttgggagacttcccatttgaa

SEQ ID NO: 5887 - DNA, 28 bp, Artificial Sequence
  Synthetic
cagtcatttgggaaactctacttgtcct

SEQ ID NO: 5888 - DNA, 28 bp, Artificial Sequence
  Synthetic
cagtcatttggggacctggacatgtttg

SEQ ID NO: 5889 - DNA, 28 bp, Artificial Sequence
  Synthetic
cagtcatttgggatggagatagatatag

SEQ ID NO: 5890 - DNA, 28 bp, Artificial Sequence
  Synthetic
cagtcatttgggggctagcaacagcgct

SEQ ID NO: 5891 - DNA, 28 bp, Artificial Sequence
  Synthetic
cagtcatttgggacagtctgctgaggtt

SEQ ID NO: 5892 - DNA, 28 bp, Artificial Sequence
  Synthetic
cagtcatttgggatcccttgcaggggct

SEQ ID NO: 5893 - DNA, 28 bp, Artificial Sequence
  Synthetic
cagtcatttgggtagtaccagtaccttg

SEQ ID NO: 5894 - DNA, 28 bp, Artificial Sequence
  Synthetic
cagtcatttgggagggggaaagttctat

SEQ ID NO: 5895 - DNA, 28 bp, Artificial Sequence
  Synthetic
cagtcatttgggagctgtctgaaaatgt

SEQ ID NO: 5896 - DNA, 28 bp, Artificial Sequence
  Synthetic
cagtcatttggggtgagtctctaagaaa

SEQ ID NO: 5897 - DNA, 28 bp, Artificial Sequence
  Synthetic
cagtcatttgggtctagtaagagtggca

SEQ ID NO: 5898 - DNA, 28 bp, Artificial Sequence
  Synthetic
cagtcatttggggttctcccaacgtaag

SEQ ID NO: 5899 - DNA, 28 bp, Artificial Sequence
  Synthetic
cagtcatttgggagtattctgtaccagg

SEQ ID NO: 5900 - DNA, 28 bp, Artificial Sequence
  Synthetic
cagtcatttgggagacctggcccagacc

SEQ ID NO: 5901 - DNA, 28 bp, Artificial Sequence
  Synthetic
cagtcatttggggtgtctgcttcctgtg

SEQ ID NO: 5902 - DNA, 28 bp, Artificial Sequence
  Synthetic
cagtcatttgggctaatagtatctacca

SEQ ID NO: 5903 - DNA, 28 bp, Artificial Sequence
  Synthetic
cagtcatttgggaaccagcaccccaact

SEQ ID NO: 5904 - DNA, 28 bp, Artificial Sequence
  Synthetic
cagtcatttgggacttgggcactgaaac

SEQ ID NO: 5905 - DNA, 28 bp, Artificial Sequence
  Synthetic
cagtcatttgggtgtgcttgctcgtccc

SEQ ID NO: 5906 - DNA, 28 bp, Artificial Sequence
  Synthetic
cagtcatttgggactgggggctttcggg

SEQ ID NO: 5907 - DNA, 28 bp, Artificial Sequence
  Synthetic
cagtcatttgggagggatcgcgggcggg

SEQ ID NO: 5908 - DNA, 28 bp, Artificial Sequence
  Synthetic
cagtcatttgggatcgctgcggttgcga

SEQ ID NO: 5909 - DNA, 28 bp, Artificial Sequence
  Synthetic
cagtcatttgggatgatccaggaacctg

SEQ ID NO: 5910 - DNA, 28 bp, Artificial Sequence
  Synthetic
cagtcatttgggaaagacataggataga

SEQ ID NO: 5911 - DNA, 28 bp, Artificial Sequence
  Synthetic
cagtcatttggggtccctctccaaatgt

SEQ ID NO: 5912 - DNA, 28 bp, Artificial Sequence
  Synthetic
cagtcatttgggacttgtatgctagctc

SEQ ID NO: 5913 - DNA, 28 bp, Artificial Sequence
  Synthetic
cagtcatttgggagtgtggctttcttag

SEQ ID NO: 5914 - DNA, 28 bp, Artificial Sequence
  Synthetic
cagtcatttgggtctaggctggtactgc

SEQ ID NO: 5915 - DNA, 28 bp, Artificial Sequence
  Synthetic
cagtcatttgggaagcagctgcctctga

SEQ ID NO: 5916 - DNA, 28 bp, Artificial Sequence
  Synthetic
cagtcatttggggtggctgcactcactt

SEQ ID NO: 5917 - DNA, 28 bp, Artificial Sequence
  Synthetic
cagtcatttgggaagtgtgcagggcact

SEQ ID NO: 5918 - DNA, 28 bp, Artificial Sequence
  Synthetic
cagtcatttgggaaacctgtgttgttca

SEQ ID NO: 5919 - DNA, 28 bp, Artificial Sequence
  Synthetic
cagtcatttgggaggaggcagcgctctc

SEQ ID NO: 5920 - DNA, 28 bp, Artificial Sequence
  Synthetic
cagtcatttgggtttaggataagcttga

SEQ ID NO: 5921 - DNA, 28 bp, Artificial Sequence
  Synthetic
cagtcatttgggaatggcgccactaggg

SEQ ID NO: 5922 - DNA, 28 bp, Artificial Sequence
  Synthetic
cagtcatttgggttgaaacaatctctac

SEQ ID NO: 5923 - DNA, 28 bp, Artificial Sequence
  Synthetic
cagtcatttgggtggtgggccgcagaac

SEQ ID NO: 5924 - DNA, 28 bp, Artificial Sequence
  Synthetic
cagtcatttgggataatacatggttaac

SEQ ID NO: 5925 - DNA, 28 bp, Artificial Sequence
  Synthetic
cagtcatttgggaatattatacagtcaa

SEQ ID NO: 5926 - DNA, 28 bp, Artificial Sequence
  Synthetic
cagtcatttgggggcaggttctcaccct

SEQ ID NO: 5927 - DNA, 28 bp, Artificial Sequence
  Synthetic
cagtcatttgggggcggagggaagtagg

SEQ ID NO: 5928 - DNA, 28 bp, Artificial Sequence
  Synthetic
cagtcatttgggcttggttcagggaggg

SEQ ID NO: 5929 - DNA, 28 bp, Artificial Sequence
  Synthetic
cagtcatttgggtacccattgcatatcg

SEQ ID NO: 5930 - DNA, 28 bp, Artificial Sequence
  Synthetic
cagtcatttgggtgcctgggtctctggc

SEQ ID NO: 5931 - DNA, 28 bp, Artificial Sequence
  Synthetic
cagtcatttgggtcccacgttgtggccc

SEQ ID NO: 5932 - DNA, 28 bp, Artificial Sequence
  Synthetic
cagtcatttgggaggcggggcgccgcgg

SEQ ID NO: 5933 - DNA, 28 bp, Artificial Sequence
  Synthetic
cagtcatttgggtgtcactcggctcggc

SEQ ID NO: 5934 - DNA, 28 bp, Artificial Sequence
  Synthetic
cagtcatttgggaggaagccctggaggg

SEQ ID NO: 5935 - DNA, 28 bp, Artificial Sequence
  Synthetic
cagtcatttgggtggaagactagtgatt

SEQ ID NO: 5936 - DNA, 28 bp, Artificial Sequence
  Synthetic
cagtcatttgggtttgtgacctggtcca

SEQ ID NO: 5937 - DNA, 28 bp, Artificial Sequence
  Synthetic
cagtcatttgggtggaggagaaggaagg

SEQ ID NO: 5938 - DNA, 28 bp, Artificial Sequence
  Synthetic
cagtcatttgggactccagccccacagc

SEQ ID NO: 5939 - DNA, 28 bp, Artificial Sequence
  Synthetic
cagtcatttgggtctgctcataccccat

SEQ ID NO: 5940 - DNA, 28 bp, Artificial Sequence
  Synthetic
cagtcatttgggtgcaccatggttgtct

SEQ ID NO: 5941 - DNA, 28 bp, Artificial Sequence
  Synthetic
cagtcatttgggtcacaatgctgacact

SEQ ID NO: 5942 - DNA, 28 bp, Artificial Sequence
  Synthetic
cagtcatttggggttggaggatgaaagt

SEQ ID NO: 5943 - DNA, 28 bp, Artificial Sequence
  Synthetic
cagtcatttgggctgggatctccggggt

SEQ ID NO: 5944 - DNA, 28 bp, Artificial Sequence
  Synthetic
cagtcatttgggtgagacctctgggttc

SEQ ID NO: 5945 - DNA, 28 bp, Artificial Sequence
  Synthetic
cagtcatttgggtccagtaccacgtgtc

SEQ ID NO: 5946 - DNA, 28 bp, Artificial Sequence
  Synthetic
cagtcatttggggattgctctgcgtgcg

SEQ ID NO: 5947 - DNA, 28 bp, Artificial Sequence
  Synthetic
cagtcatttgggcagtaacaaagattca

SEQ ID NO: 5948 - DNA, 28 bp, Artificial Sequence
  Synthetic
cagtcatttgggtctttggttatctagc

SEQ ID NO: 5949 - DNA, 28 bp, Artificial Sequence
  Synthetic
cagtcatttgggtaaagctagataaccg

SEQ ID NO: 5950 - DNA, 28 bp, Artificial Sequence
  Synthetic
cagtcatttgggtattgcacttgtcccg

SEQ ID NO: 5951 - DNA, 28 bp, Artificial Sequence
  Synthetic
cagtcatttgggtattgcactcgtcccg

SEQ ID NO: 5952 - DNA, 28 bp, Artificial Sequence
  Synthetic
cagtcatttgggaaagtgctgttcgtgc

SEQ ID NO: 5953 - DNA, 28 bp, Artificial Sequence
  Synthetic
cagtcatttgggttcaacgggtatttat

SEQ ID NO: 5954 - DNA, 28 bp, Artificial Sequence
  Synthetic
cagtcatttgggtttggcactagcacat

SEQ ID NO: 5955 - DNA, 28 bp, Artificial Sequence
  Synthetic
cagtcatttgggtgaggtagtaagttgt

SEQ ID NO: 5956 - DNA, 28 bp, Artificial Sequence
  Synthetic
cagtcatttgggaacccgtagatccgat

SEQ ID NO: 5957 - DNA, 28 bp, Artificial Sequence
  Synthetic
cagtcatttgggcacccgtagaaccgac

SEQ ID NO: 5958 - DNA, 28 bp, Artificial Sequence
  Synthetic
cagtcatttgggtggaaggacgggaagt

SEQ ID NO: 5959 - DNA, 28 bp, Artificial Sequence
  Synthetic
cagtcatttgggattacaggaaactggg

SEQ ID NO: 5960 - DNA, 28 bp, Artificial Sequence
  Synthetic
cagtcatttgggtagtgttgtccccccg

SEQ ID NO: 5961 - DNA, 28 bp, Artificial Sequence
  Synthetic
cagtcatttgggtggtgttgtccccccg

SEQ ID NO: 5962 - DNA, 28 bp, Artificial Sequence
  Synthetic
cagtcatttgggttaatgcttagcctgt

SEQ ID NO: 5963 - DNA, 28 bp, Artificial Sequence
  Synthetic
cagtcatttgggaccaggccaccattcc

SEQ ID NO: 5964 - DNA, 28 bp, Artificial Sequence
  Synthetic
cagtcatttgggaactgtagtccgggtc

SEQ ID NO: 5965 - DNA, 28 bp, Artificial Sequence
  Synthetic
cagtcatttgggtcacattctgaggacg

SEQ ID NO: 5966 - DNA, 28 bp, Artificial Sequence
  Synthetic
cagtcatttgggtcgcggtcacagaatg

SEQ ID NO: 5967 - DNA, 28 bp, Artificial Sequence
  Synthetic
cagtcatttgggtagaatactgaggcct

SEQ ID NO: 5968 - DNA, 28 bp, Artificial Sequence
  Synthetic
cagtcatttgggagctaaaccgcagtac

SEQ ID NO: 5969 - DNA, 28 bp, Artificial Sequence
  Synthetic
cagtcatttgggtaggatgcctggaact

SEQ ID NO: 5970 - DNA, 28 bp, Artificial Sequence
  Synthetic
cagtcatttgggtgatggttttcgggct

SEQ ID NO: 5971 - DNA, 28 bp, Artificial Sequence
  Synthetic
cagtcatttgggccagcagcacctaatc

SEQ ID NO: 5972 - DNA, 28 bp, Artificial Sequence
  Synthetic
cagtcatttgggtgatcccatgttgctg

SEQ ID NO: 5973 - DNA, 28 bp, Artificial Sequence
  Synthetic
cagtcatttgggtaggcgcgactgagag

SEQ ID NO: 5974 - DNA, 28 bp, Artificial Sequence
  Synthetic
cagtcatttgggctgggtatacgcagct

SEQ ID NO: 5975 - DNA, 28 bp, Artificial Sequence
  Synthetic
cagtcatttgggacccagctgcgtaaac

SEQ ID NO: 5976 - DNA, 28 bp, Artificial Sequence
  Synthetic
cagtcatttgggtccctgagaccctaac

SEQ ID NO: 5977 - DNA, 28 bp, Artificial Sequence
  Synthetic
cagtcatttgggtagcagcacataatgg

SEQ ID NO: 5978 - DNA, 28 bp, Artificial Sequence
  Synthetic
cagtcatttgggtagcagcacgtaaata

SEQ ID NO: 5979 - DNA, 28 bp, Artificial Sequence
  Synthetic
cagtcatttgggactgcagtgaaggcac

SEQ ID NO: 5980 - DNA, 28 bp, Artificial Sequence
  Synthetic
cagtcatttgggcaaagtgcttacagtg

SEQ ID NO: 5981 - DNA, 28 bp, Artificial Sequence
  Synthetic
cagtcatttgggtaaggtgcatctagtg

SEQ ID NO: 5982 - DNA, 28 bp, Artificial Sequence
  Synthetic
cagtcatttgggtgtgcaaatctatgca

SEQ ID NO: 5983 - DNA, 28 bp, Artificial Sequence
  Synthetic
cagtcatttgggtgtgcaaatccatgca

SEQ ID NO: 5984 - DNA, 28 bp, Artificial Sequence
  Synthetic
cagtcatttgggtaaagtgcttatagtg

SEQ ID NO: 5985 - DNA, 28 bp, Artificial Sequence
  Synthetic
cagtcatttgggtaatctcagctggcaa

SEQ ID NO: 5986 - DNA, 28 bp, Artificial Sequence
  Synthetic
cagtcatttgggttgtgcttgatctaac

SEQ ID NO: 5987 - DNA, 28 bp, Artificial Sequence
  Synthetic
cagtcatttgggaagctgccagttgaag

SEQ ID NO: 5988 - DNA, 28 bp, Artificial Sequence
  Synthetic
cagtcatttgggatcacattgccaggga

SEQ ID NO: 5989 - DNA, 28 bp, Artificial Sequence
  Synthetic
cagtcatttgggttcacagtggctaagt

SEQ ID NO: 5990 - DNA, 28 bp, Artificial Sequence
  Synthetic
cagtcatttgggtattgcacttgtcccg

SEQ ID NO: 5991 - DNA, 28 bp, Artificial Sequence
  Synthetic
cagtcatttgggaacccgtagatccgaa

SEQ ID NO: 5992 - DNA, 28 bp, Artificial Sequence
  Synthetic
cagtcatttgggtacagtactgtgataa

SEQ ID NO: 5993 - DNA, 28 bp, Artificial Sequence
  Synthetic
cagtcatttgggagcagcattgtacagg

SEQ ID NO: 5994 - DNA, 28 bp, Artificial Sequence
  Synthetic
cagtcatttgggtcaaatgctcagactc

SEQ ID NO: 5995 - DNA, 28 bp, Artificial Sequence
  Synthetic
cagtcatttgggtaaagtgctgacagtg

SEQ ID NO: 5996 - DNA, 28 bp, Artificial Sequence
  Synthetic
cagtcatttgggagcagcattgtacagg

SEQ ID NO: 5997 - DNA, 28 bp, Artificial Sequence
  Synthetic
cagtcatttgggttaaggcacgcggtga

SEQ ID NO: 5998 - DNA, 28 bp, Artificial Sequence
  Synthetic
cagtcatttgggtccctgagaccctaac

SEQ ID NO: 5999 - DNA, 28 bp, Artificial Sequence
  Synthetic
cagtcatttgggtcggatccgtctgagc

SEQ ID NO: 6000 - DNA, 28 bp, Artificial Sequence
  Synthetic
cagtcatttgggttggtccccttcaacc

SEQ ID NO: 6001 - DNA, 28 bp, Artificial Sequence
  Synthetic
cagtcatttgggtatggctttttattcc

SEQ ID NO: 6002 - DNA, 28 bp, Artificial Sequence
  Synthetic
cagtcatttgggtctacagtgcacgtgt

SEQ ID NO: 6003 - DNA, 28 bp, Artificial Sequence
  Synthetic
cagtcatttgggtgagatgaagcactgt

SEQ ID NO: 6004 - DNA, 28 bp, Artificial Sequence
  Synthetic
cagtcatttgggtagcagcacataatgg

SEQ ID NO: 6005 - DNA, 28 bp, Artificial Sequence
  Synthetic
cagtcatttgggtagcagcacatcatgg

SEQ ID NO: 6006 - DNA, 28 bp, Artificial Sequence
  Synthetic
cagtcatttgggtagcagcacgtaaata

SEQ ID NO: 6007 - DNA, 28 bp, Artificial Sequence
  Synthetic
cagtcatttgggactgcagtgaaggcac

SEQ ID NO: 6008 - DNA, 28 bp, Artificial Sequence
  Synthetic
cagtcatttgggcaaagtgcttacagtg

SEQ ID NO: 6009 - DNA, 28 bp, Artificial Sequence
  Synthetic
cagtcatttgggtaaggtgcatctagtg

SEQ ID NO: 6010 - DNA, 28 bp, Artificial Sequence
  Synthetic
cagtcatttgggaacattcaacgctgtc

SEQ ID NO: 6011 - DNA, 28 bp, Artificial Sequence
  Synthetic
cagtcatttgggaccatcgaccgttgat

SEQ ID NO: 6012 - DNA, 28 bp, Artificial Sequence
  Synthetic
cagtcatttgggaacattcattgctgtc

SEQ ID NO: 6013 - DNA, 28 bp, Artificial Sequence
  Synthetic
cagtcatttgggtaggtagtttcatgtt

SEQ ID NO: 6014 - DNA, 28 bp, Artificial Sequence
  Synthetic
cagtcatttgggggtccagaagggagct

SEQ ID NO: 6015 - DNA, 28 bp, Artificial Sequence
  Synthetic
cagtcatttgggcccagtgttcagacta

SEQ ID NO: 6016 - DNA, 28 bp, Artificial Sequence
  Synthetic
cagtcatttgggtgtgcaaatctatgca

SEQ ID NO: 6017 - DNA, 28 bp, Artificial Sequence
  Synthetic
cagtcatttgggtgtgcaaatccatgca

SEQ ID NO: 6018 - DNA, 28 bp, Artificial Sequence
  Synthetic
cagtcatttgggtaaagtgcttatagtg

SEQ ID NO: 6019 - DNA, 28 bp, Artificial Sequence
  Synthetic
cagtcatttgggtccttcattccaccgg

SEQ ID NO: 6020 - DNA, 28 bp, Artificial Sequence
  Synthetic
cagtcatttgggttgtgcttgatctaac

SEQ ID NO: 6021 - DNA, 28 bp, Artificial Sequence
  Synthetic
cagtcatttgggaagctgccagttgaag

SEQ ID NO: 6022 - DNA, 28 bp, Artificial Sequence
  Synthetic
cagtcatttgggcattgcacttgtctcg

SEQ ID NO: 6023 - DNA, 28 bp, Artificial Sequence
  Synthetic
cagtcatttgggttcaagtaatccagga

SEQ ID NO: 6024 - DNA, 28 bp, Artificial Sequence
  Synthetic
cagtcatttgggaaggagctcacagtct

SEQ ID NO: 6025 - DNA, 28 bp, Artificial Sequence
  Synthetic
cagtcatttgggctagcaccatctgaaa

SEQ ID NO: 6026 - DNA, 28 bp, Artificial Sequence
  Synthetic
cagtcatttgggtagcaccatttgaaat

SEQ ID NO: 6027 - DNA, 28 bp, Artificial Sequence
  Synthetic
cagtcatttgggtgtaaacatcctacac

SEQ ID NO: 6028 - DNA, 28 bp, Artificial Sequence
  Synthetic
cagtcatttgggtgtaaacatcctacac

SEQ ID NO: 6029 - DNA, 28 bp, Artificial Sequence
  Synthetic
cagtcatttgggtggcagtgtcttagct

SEQ ID NO: 6030 - DNA, 28 bp, Artificial Sequence
  Synthetic
cagtcatttgggtggaagactagtgatt

SEQ ID NO: 6031 - DNA, 28 bp, Artificial Sequence
  Synthetic
cagtcatttgggtctttggttatctagc

SEQ ID NO: 6032 - DNA, 28 bp, Artificial Sequence
  Synthetic
cagtcatttgggtattgcacttgtcccg

SEQ ID NO: 6033 - DNA, 28 bp, Artificial Sequence
  Synthetic
cagtcatttgggaaagtgctgttcgtgc

SEQ ID NO: 6034 - DNA, 28 bp, Artificial Sequence
  Synthetic
cagtcatttgggttcaacgggtatttat

SEQ ID NO: 6035 - DNA, 28 bp, Artificial Sequence
  Synthetic
cagtcatttgggaacccgtagatccgat

SEQ ID NO: 6036 - DNA, 28 bp, Artificial Sequence
  Synthetic
cagtcatttgggtgaggtagtaggttgt

SEQ ID NO: 6037 - DNA, 28 bp, Artificial Sequence
  Synthetic
cagtcatttgggtgaggtagtaggttgt

SEQ ID NO: 6038 - DNA, 28 bp, Artificial Sequence
  Synthetic
cagtcatttgggagaggtagtaggttgc

SEQ ID NO: 6039 - DNA, 28 bp, Artificial Sequence
  Synthetic
cagtcatttgggtgaggtagtagattgt

SEQ ID NO: 6040 - DNA, 28 bp, Artificial Sequence
  Synthetic
cagtcatttgggtgaggtagtagtttgt

SEQ ID NO: 6041 - DNA, 28 bp, Artificial Sequence
  Synthetic
cagtcatttgggtgaggtagtagtttgt

SEQ ID NO: 6042 - DNA, 28 bp, Artificial Sequence
  Synthetic
cagtcatttgggtggaatgtaaagaagt

SEQ ID NO: 6043 - DNA, 28 bp, Artificial Sequence
  Synthetic
cagtcatttgggaacccgtagatccgaa

SEQ ID NO: 6044 - DNA, 28 bp, Artificial Sequence
  Synthetic
cagtcatttgggtacagtactgtgataa

SEQ ID NO: 6045 - DNA, 28 bp, Artificial Sequence
  Synthetic
cagtcatttgggagcagcattgtacagg

SEQ ID NO: 6046 - DNA, 28 bp, Artificial Sequence
  Synthetic
cagtcatttgggagcagcattgtacagg

SEQ ID NO: 6047 - DNA, 28 bp, Artificial Sequence
  Synthetic
cagtcatttgggtaccctgtagatccga

SEQ ID NO: 6048 - DNA, 28 bp, Artificial Sequence
  Synthetic
cagtcatttgggataccctgtagaaccg

SEQ ID NO: 6049 - DNA, 28 bp, Artificial Sequence
  Synthetic
cagtcatttgggtggagtgtgacaatgg

SEQ ID NO: 6050 - DNA, 28 bp, Artificial Sequence
  Synthetic
cagtcatttgggttaaggcacgcggtga

SEQ ID NO: 6051 - DNA, 28 bp, Artificial Sequence
  Synthetic
cagtcatttgggtccctgagaccctaac

SEQ ID NO: 6052 - DNA, 28 bp, Artificial Sequence
  Synthetic
cagtcatttgggtcacagtgaaccggtc

SEQ ID NO: 6053 - DNA, 28 bp, Artificial Sequence
  Synthetic
cagtcatttgggctttttgcggtctggg

SEQ ID NO: 6054 - DNA, 28 bp, Artificial Sequence
  Synthetic
cagtcatttgggcagtgcaatgtaaaaa

SEQ ID NO: 6055 - DNA, 28 bp, Artificial Sequence
  Synthetic
cagtcatttgggtaacagtctacagcca

SEQ ID NO: 6056 - DNA, 28 bp, Artificial Sequence
  Synthetic
cagtcatttgggttggtccccttcaacc

SEQ ID NO: 6057 - DNA, 28 bp, Artificial Sequence
  Synthetic
cagtcatttgggtatggctttttattcc

SEQ ID NO: 6058 - DNA, 28 bp, Artificial Sequence
  Synthetic
cagtcatttgggtatggcttttcattcc

SEQ ID NO: 6059 - DNA, 28 bp, Artificial Sequence
  Synthetic
cagtcatttgggtattgcttaagaatac

SEQ ID NO: 6060 - DNA, 28 bp, Artificial Sequence
  Synthetic
cagtcatttgggagctggtgttgtgaat

SEQ ID NO: 6061 - DNA, 28 bp, Artificial Sequence
  Synthetic
cagtcatttgggtaacactgtctggtaa

SEQ ID NO: 6062 - DNA, 28 bp, Artificial Sequence
  Synthetic
cagtcatttgggtgtagtgtttcctact

SEQ ID NO: 6063 - DNA, 28 bp, Artificial Sequence
  Synthetic
cagtcatttgggtgagatgaagcactgt

SEQ ID NO: 6064 - DNA, 28 bp, Artificial Sequence
  Synthetic
cagtcatttgggtacagtatagatgatg

SEQ ID NO: 6065 - DNA, 28 bp, Artificial Sequence
  Synthetic
cagtcatttggggtccagttttcccagg

SEQ ID NO: 6066 - DNA, 28 bp, Artificial Sequence
  Synthetic
cagtcatttgggtcagtgcatgacagaa

SEQ ID NO: 6067 - DNA, 28 bp, Artificial Sequence
  Synthetic
cagtcatttgggtagcagcacataatgg

SEQ ID NO: 6068 - DNA, 28 bp, Artificial Sequence
  Synthetic
cagtcatttgggtagcagcacgtaaata

SEQ ID NO: 6069 - DNA, 28 bp, Artificial Sequence
  Synthetic
cagtcatttgggactgcagtgaaggcac

SEQ ID NO: 6070 - DNA, 28 bp, Artificial Sequence
  Synthetic
cagtcatttgggcaaagtgcttacagtg

SEQ ID NO: 6071 - DNA, 28 bp, Artificial Sequence
  Synthetic
cagtcatttgggtaaggtgcatctagtg

SEQ ID NO: 6072 - DNA, 28 bp, Artificial Sequence
  Synthetic
cagtcatttgggaacattcaacgctgtc

SEQ ID NO: 6073 - DNA, 28 bp, Artificial Sequence
  Synthetic
cagtcatttgggaacattcattgctgtc

SEQ ID NO: 6074 - DNA, 28 bp, Artificial Sequence
  Synthetic
cagtcatttgggaacattcaacgctgtc

SEQ ID NO: 6075 - DNA, 28 bp, Artificial Sequence
  Synthetic
cagtcatttgggtttggcaatggtagaa

SEQ ID NO: 6076 - DNA, 28 bp, Artificial Sequence
  Synthetic
cagtcatttgggtatggcactggtagaa

SEQ ID NO: 6077 - DNA, 28 bp, Artificial Sequence
  Synthetic
cagtcatttgggtggacggagaactgat

SEQ ID NO: 6078 - DNA, 28 bp, Artificial Sequence
  Synthetic
cagtcatttgggcaaagaattctccttt

SEQ ID NO: 6079 - DNA, 28 bp, Artificial Sequence
  Synthetic
cagtcatttgggtcgtgtcttgtgttgc

SEQ ID NO: 6080 - DNA, 28 bp, Artificial Sequence
  Synthetic
cagtcatttgggcaacggaatcccaaaa

SEQ ID NO: 6081 - DNA, 28 bp, Artificial Sequence
  Synthetic
cagtcatttgggaactggcctacaaagt

SEQ ID NO: 6082 - DNA, 28 bp, Artificial Sequence
  Synthetic
cagtcatttgggtaggtagtttcctgtt

SEQ ID NO: 6083 - DNA, 28 bp, Artificial Sequence
  Synthetic
cagtcatttgggcccagtgtttagacta

SEQ ID NO: 6084 - DNA, 28 bp, Artificial Sequence
  Synthetic
cagtcatttgggtgtgcaaatctatgca

SEQ ID NO: 6085 - DNA, 28 bp, Artificial Sequence
  Synthetic
cagtcatttgggtgtgcaaatccatgca

SEQ ID NO: 6086 - DNA, 28 bp, Artificial Sequence
  Synthetic
cagtcatttgggtaaagtgcttatagtg

SEQ ID NO: 6087 - DNA, 28 bp, Artificial Sequence
  Synthetic
cagtcatttgggtaacactgtctggtaa

SEQ ID NO: 6088 - DNA, 28 bp, Artificial Sequence
  Synthetic
cagtcatttgggcatcttactagacagt

SEQ ID NO: 6089 - DNA, 28 bp, Artificial Sequence
  Synthetic
cagtcatttgggtaatactgcctggtaa

SEQ ID NO: 6090 - DNA, 28 bp, Artificial Sequence
  Synthetic
cagtcatttgggtaatactgccgggtaa

SEQ ID NO: 6091 - DNA, 28 bp, Artificial Sequence
  Synthetic
cagtcatttggggtgaaatgtttaggac

SEQ ID NO: 6092 - DNA, 28 bp, Artificial Sequence
  Synthetic
cagtcatttgggttccctttgtcatcct

SEQ ID NO: 6093 - DNA, 28 bp, Artificial Sequence
  Synthetic
cagtcatttgggtggaatgtaaggaagt

SEQ ID NO: 6094 - DNA, 28 bp, Artificial Sequence
  Synthetic
cagtcatttgggataagacgagcaaaaa

SEQ ID NO: 6095 - DNA, 28 bp, Artificial Sequence
  Synthetic
cagtcatttgggtagcttatcagactga

SEQ ID NO: 6096 - DNA, 28 bp, Artificial Sequence
  Synthetic
cagtcatttgggtaacagtctccagtca

SEQ ID NO: 6097 - DNA, 28 bp, Artificial Sequence
  Synthetic
cagtcatttgggacagcaggcacagaca

SEQ ID NO: 6098 - DNA, 28 bp, Artificial Sequence
  Synthetic
cagtcatttgggtaatctcagctggcaa

SEQ ID NO: 6099 - DNA, 28 bp, Artificial Sequence
  Synthetic
cagtcatttgggtactgcatcaggaact

SEQ ID NO: 6100 - DNA, 28 bp, Artificial Sequence
  Synthetic
cagtcatttgggttgtgcttgatctaac

SEQ ID NO: 6101 - DNA, 28 bp, Artificial Sequence
  Synthetic
cagtcatttgggtgattgtccaaacgca

SEQ ID NO: 6102 - DNA, 28 bp, Artificial Sequence
  Synthetic
cagtcatttgggaagctgccagttgaag

SEQ ID NO: 6103 - DNA, 28 bp, Artificial Sequence
  Synthetic
cagtcatttgggagctacattgtctgct

SEQ ID NO: 6104 - DNA, 28 bp, Artificial Sequence
  Synthetic
cagtcatttgggagctacatctggctac

SEQ ID NO: 6105 - DNA, 28 bp, Artificial Sequence
  Synthetic
cagtcatttgggtgtcagtttgtcaaat

SEQ ID NO: 6106 - DNA, 28 bp, Artificial Sequence
  Synthetic
cagtcatttgggatcacattgccaggga

SEQ ID NO: 6107 - DNA, 28 bp, Artificial Sequence
  Synthetic
cagtcatttgggatcacattgccaggga

SEQ ID NO: 6108 - DNA, 28 bp, Artificial Sequence
  Synthetic
cagtcatttgggtggctcagttcagcag

SEQ ID NO: 6109 - DNA, 28 bp, Artificial Sequence
  Synthetic
cagtcatttgggcattgcacttgtctcg

SEQ ID NO: 6110 - DNA, 28 bp, Artificial Sequence
  Synthetic
cagtcatttgggttcacagtggctaagt

SEQ ID NO: 6111 - DNA, 28 bp, Artificial Sequence
  Synthetic
cagtcatttgggttcacagtggctaagt

SEQ ID NO: 6112 - DNA, 28 bp, Artificial Sequence
  Synthetic
cagtcatttgggtagcaccatttgaaat

SEQ ID NO: 6113 - DNA, 28 bp, Artificial Sequence
  Synthetic
cagtcatttgggtagcaccatttgaaat

SEQ ID NO: 6114 - DNA, 28 bp, Artificial Sequence
  Synthetic
cagtcatttgggtaagtgcttccatgtt

SEQ ID NO: 6115 - DNA, 28 bp, Artificial Sequence
  Synthetic
cagtcatttgggtaagtgcttccatgtt

SEQ ID NO: 6116 - DNA, 28 bp, Artificial Sequence
  Synthetic
cagtcatttgggtaagtgcttccatgtt

SEQ ID NO: 6117 - DNA, 28 bp, Artificial Sequence
  Synthetic
cagtcatttgggtaagtgcttccatgtt

SEQ ID NO: 6118 - DNA, 28 bp, Artificial Sequence
  Synthetic
cagtcatttgggtgtaaacatcctcgac

SEQ ID NO: 6119 - DNA, 28 bp, Artificial Sequence
  Synthetic
cagtcatttgggggaggcaagatgttgg

SEQ ID NO: 6120 - DNA, 28 bp, Artificial Sequence
  Synthetic
cagtcatttgggtattgcacattactaa

SEQ ID NO: 6121 - DNA, 28 bp, Artificial Sequence
  Synthetic
cagtcatttgggtccagcatcagtgatt

SEQ ID NO: 6122 - DNA, 28 bp, Artificial Sequence
  Synthetic
cagtcatttgggtggcagtgtcttagct

SEQ ID NO: 6123 - DNA, 28 bp, Artificial Sequence
  Synthetic
cagtcatttgggtaatgcccctaaaaat

SEQ ID NO: 6124 - DNA, 28 bp, Artificial Sequence
  Synthetic
cagtcatttggggaattgcactttagca

SEQ ID NO: 6125 - DNA, 28 bp, Artificial Sequence
  Synthetic
cagtcatttgggttttgttcgttcggct

SEQ ID NO: 6126 - DNA, 28 bp, Artificial Sequence
  Synthetic
cagtcatttgggagatcagaaggtgatt

SEQ ID NO: 6127 - DNA, 28 bp, Artificial Sequence
  Synthetic
cagtcatttgggatcgggaatatcgtgt

SEQ ID NO: 6128 - DNA, 28 bp, Artificial Sequence
  Synthetic
cagtcatttgggtggcagtgtattgtta

SEQ ID NO: 6129 - DNA, 28 bp, Artificial Sequence
  Synthetic
cagtcatttgggaaaccgttaccattac

SEQ ID NO: 6130 - DNA, 28 bp, Artificial Sequence
  Synthetic
cagtcatttgggtggaagactagtgatt

SEQ ID NO: 6131 - DNA, 28 bp, Artificial Sequence
  Synthetic
cagtcatttgggtctttggttatctagc

SEQ ID NO: 6132 - DNA, 28 bp, Artificial Sequence
  Synthetic
cagtcatttgggtaaagctagataaccg

SEQ ID NO: 6133 - DNA, 28 bp, Artificial Sequence
  Synthetic
cagtcatttgggtattgcacttgtcccg

SEQ ID NO: 6134 - DNA, 28 bp, Artificial Sequence
  Synthetic
cagtcatttgggaaagtgctgttcgtgc

SEQ ID NO: 6135 - DNA, 28 bp, Artificial Sequence
  Synthetic
cagtcatttgggtttggcactagcacat

SEQ ID NO: 6136 - DNA, 28 bp, Artificial Sequence
  Synthetic
cagtcatttgggtgcttgttcactgtgc

SEQ ID NO: 6137 - DNA, 28 bp, Artificial Sequence
  Synthetic
cagtcatttggggttgtattctgcccgg

SEQ ID NO: 6138 - DNA, 28 bp, Artificial Sequence
  Synthetic
cagtcatttgggcggactgccgcagaat

SEQ ID NO: 6139 - DNA, 28 bp, Artificial Sequence
  Synthetic
cagtcatttgggatgaaaatgtgaaacc

SEQ ID NO: 6140 - DNA, 28 bp, Artificial Sequence
  Synthetic
cagtcatttgggttaatgctgtatcgga

SEQ ID NO: 6141 - DNA, 28 bp, Artificial Sequence
  Synthetic
cagtcatttgggaatggttctgacagca

SEQ ID NO: 6142 - DNA, 28 bp, Artificial Sequence
  Synthetic
cagtcatttgggtgtgtatcgtggtcgt

SEQ ID NO: 6143 - DNA, 28 bp, Artificial Sequence
  Synthetic
cagtcatttggggagatccctgcgaaat

SEQ ID NO: 6144 - DNA, 28 bp, Artificial Sequence
  Synthetic
cagtcatttgggtcgagatctctacgag

SEQ ID NO: 6145 - DNA, 28 bp, Artificial Sequence
  Synthetic
cagtcatttggggtgacctctacggaac

SEQ ID NO: 6146 - DNA, 28 bp, Artificial Sequence
  Synthetic
cagtcatttgggtagaaatggccgtact

SEQ ID NO: 6147 - DNA, 28 bp, Artificial Sequence
  Synthetic
cagtcatttgggcagaccccctctcccc

SEQ ID NO: 6148 - DNA, 28 bp, Artificial Sequence
  Synthetic
cagtcatttggggaggtgagcaggagtt

SEQ ID NO: 6149 - DNA, 28 bp, Artificial Sequence
  Synthetic
cagtcatttgggtcgaggagcacgtgtt

SEQ ID NO: 6150 - DNA, 28 bp, Artificial Sequence
  Synthetic
cagtcatttgggagagttgagatcgggt

SEQ ID NO: 6151 - DNA, 28 bp, Artificial Sequence
  Synthetic
cagtcatttgggtgaaactgtgtgaggt

SEQ ID NO: 6152 - DNA, 28 bp, Artificial Sequence
  Synthetic
cagtcatttggggatatcgcgcccacct

SEQ ID NO: 6153 - DNA, 28 bp, Artificial Sequence
  Synthetic
cagtcatttgggaaaggtggaggtgcgg

SEQ ID NO: 6154 - DNA, 28 bp, Artificial Sequence
  Synthetic
cagtcatttgggagcactcactgggggt

SEQ ID NO: 6155 - DNA, 28 bp, Artificial Sequence
  Synthetic
cagtcatttgggtcacatttgcctggac

SEQ ID NO: 6156 - DNA, 28 bp, Artificial Sequence
  Synthetic
cagtcatttgggaacccgtagatccgaa

SEQ ID NO: 6157 - DNA, 28 bp, Artificial Sequence
  Synthetic
cagtcatttgggtacagtactgtgataa

SEQ ID NO: 6158 - DNA, 28 bp, Artificial Sequence
  Synthetic
cagtcatttgggagcagcattgtacagg

SEQ ID NO: 6159 - DNA, 28 bp, Artificial Sequence
  Synthetic
cagtcatttgggtcaaatgctcagactc

SEQ ID NO: 6160 - DNA, 28 bp, Artificial Sequence
  Synthetic
cagtcatttgggaaaagtgcttacagtg

SEQ ID NO: 6161 - DNA, 28 bp, Artificial Sequence
  Synthetic
cagtcatttgggtaaagtgctgacagtg

SEQ ID NO: 6162 - DNA, 28 bp, Artificial Sequence
  Synthetic
cagtcatttgggagcagcattgtacagg

SEQ ID NO: 6163 - DNA, 28 bp, Artificial Sequence
  Synthetic
cagtcatttgggttaaggcacgcggtga

SEQ ID NO: 6164 - DNA, 28 bp, Artificial Sequence
  Synthetic
cagtcatttgggtccctgagaccctaac

SEQ ID NO: 6165 - DNA, 28 bp, Artificial Sequence
  Synthetic
cagtcatttgggtcggatccgtctgagc

SEQ ID NO: 6166 - DNA, 28 bp, Artificial Sequence
  Synthetic
cagtcatttgggtcacagtgaaccggtc

SEQ ID NO: 6167 - DNA, 28 bp, Artificial Sequence
  Synthetic
cagtcatttgggcagtgcaatgttaaaa

SEQ ID NO: 6168 - DNA, 28 bp, Artificial Sequence
  Synthetic
cagtcatttgggttgtccccttcaacca

SEQ ID NO: 6169 - DNA, 28 bp, Artificial Sequence
  Synthetic
cagtcatttgggtatggctttttattcc

SEQ ID NO: 6170 - DNA, 28 bp, Artificial Sequence
  Synthetic
cagtcatttgggaacactgtctggtaaa

SEQ ID NO: 6171 - DNA, 28 bp, Artificial Sequence
  Synthetic
cagtcatttggggtccagttttcccagg

SEQ ID NO: 6172 - DNA, 28 bp, Artificial Sequence
  Synthetic
cagtcatttgggttgcatagtcacaaaa

SEQ ID NO: 6173 - DNA, 28 bp, Artificial Sequence
  Synthetic
cagtcatttgggtagcagcacataatgg

SEQ ID NO: 6174 - DNA, 28 bp, Artificial Sequence
  Synthetic
cagtcatttgggtagcagcacatcatgg

SEQ ID NO: 6175 - DNA, 28 bp, Artificial Sequence
  Synthetic
cagtcatttgggtagcagcacgtaaata

SEQ ID NO: 6176 - DNA, 28 bp, Artificial Sequence
  Synthetic
cagtcatttgggactgcagtgaaggcac

SEQ ID NO: 6177 - DNA, 28 bp, Artificial Sequence
  Synthetic
cagtcatttgggcaaagtgcttacagtg

SEQ ID NO: 6178 - DNA, 28 bp, Artificial Sequence
  Synthetic
cagtcatttgggtaaggtgcatctagtg

SEQ ID NO: 6179 - DNA, 28 bp, Artificial Sequence
  Synthetic
cagtcatttgggaacattcaacgctgtc

SEQ ID NO: 6180 - DNA, 28 bp, Artificial Sequence
  Synthetic
cagtcatttgggaccatcgaccgttgat

SEQ ID NO: 6181 - DNA, 28 bp, Artificial Sequence
  Synthetic
cagtcatttgggaacattcattgctgtc

SEQ ID NO: 6182 - DNA, 28 bp, Artificial Sequence
  Synthetic
cagtcatttgggaacattcaacctgtcg

SEQ ID NO: 6183 - DNA, 28 bp, Artificial Sequence
  Synthetic
cagtcatttgggtttggcaatggtagaa

SEQ ID NO: 6184 - DNA, 28 bp, Artificial Sequence
  Synthetic
cagtcatttgggtatggcactggtagaa

SEQ ID NO: 6185 - DNA, 28 bp, Artificial Sequence
  Synthetic
cagtcatttgggcatcccttgcatggtg

SEQ ID NO: 6186 - DNA, 28 bp, Artificial Sequence
  Synthetic
cagtcatttggggtgcctactgagctga

SEQ ID NO: 6187 - DNA, 28 bp, Artificial Sequence
  Synthetic
cagtcatttgggtgatatgtttgatata

SEQ ID NO: 6188 - DNA, 28 bp, Artificial Sequence
  Synthetic
cagtcatttgggtgtaacagcaactcca

SEQ ID NO: 6189 - DNA, 28 bp, Artificial Sequence
  Synthetic
cagtcatttgggtaggtagtttcatgtt

SEQ ID NO: 6190 - DNA, 28 bp, Artificial Sequence
  Synthetic
cagtcatttgggggtccagaggggaaat

SEQ ID NO: 6191 - DNA, 28 bp, Artificial Sequence
  Synthetic
cagtcatttgggcccagtgttcagacta

SEQ ID NO: 6192 - DNA, 28 bp, Artificial Sequence
  Synthetic
cagtcatttgggtgtgcaaatctatgca

SEQ ID NO: 6193 - DNA, 28 bp, Artificial Sequence
  Synthetic
cagtcatttgggtgtgcaaatccatgca

SEQ ID NO: 6194 - DNA, 28 bp, Artificial Sequence
  Synthetic
cagtcatttgggtaaagtgcttatagtg

SEQ ID NO: 6195 - DNA, 28 bp, Artificial Sequence
  Synthetic
cagtcatttgggaatactgccgggtaat

SEQ ID NO: 6196 - DNA, 28 bp, Artificial Sequence
  Synthetic
cagtcatttgggtagcttatcagactga

SEQ ID NO: 6197 - DNA, 28 bp, Artificial Sequence
  Synthetic
cagtcatttgggttccctttgtcatcct

SEQ ID NO: 6198 - DNA, 28 bp, Artificial Sequence
  Synthetic
cagtcatttgggacagcaggcacagaca

SEQ ID NO: 6199 - DNA, 28 bp, Artificial Sequence
  Synthetic
cagtcatttgggatgacctatgaattga

SEQ ID NO: 6200 - DNA, 28 bp, Artificial Sequence
  Synthetic
cagtcatttgggttgtgcttgatctaac

SEQ ID NO: 6201 - DNA, 28 bp, Artificial Sequence
  Synthetic
cagtcatttgggtgattgtccaaacgca

SEQ ID NO: 6202 - DNA, 28 bp, Artificial Sequence
  Synthetic
cagtcatttgggaagctgccagttgaag

SEQ ID NO: 6203 - DNA, 28 bp, Artificial Sequence
  Synthetic
cagtcatttgggccaccaccatgtctga

SEQ ID NO: 6204 - DNA, 28 bp, Artificial Sequence
  Synthetic
cagtcatttgggagctacattgtctgct

SEQ ID NO: 6205 - DNA, 28 bp, Artificial Sequence
  Synthetic
cagtcatttgggtgtcagtttgtcaaat

SEQ ID NO: 6206 - DNA, 28 bp, Artificial Sequence
  Synthetic
cagtcatttgggcaagtcactagtggtt

SEQ ID NO: 6207 - DNA, 28 bp, Artificial Sequence
  Synthetic
cagtcatttgggatcacattgccaggga

SEQ ID NO: 6208 - DNA, 28 bp, Artificial Sequence
  Synthetic
cagtcatttgggtggctcagttcagcag

SEQ ID NO: 6209 - DNA, 28 bp, Artificial Sequence
  Synthetic
cagtcatttgggcattgcacttgtctcg

SEQ ID NO: 6210 - DNA, 28 bp, Artificial Sequence
  Synthetic
cagtcatttgggttcaagtaatccagga

SEQ ID NO: 6211 - DNA, 28 bp, Artificial Sequence
  Synthetic
cagtcatttgggttcacagtggctaagt

SEQ ID NO: 6212 - DNA, 28 bp, Artificial Sequence
  Synthetic
cagtcatttgggaaggagctcacagtct

SEQ ID NO: 6213 - DNA, 28 bp, Artificial Sequence
  Synthetic
cagtcatttgggctagcaccatctgaaa

SEQ ID NO: 6214 - DNA, 28 bp, Artificial Sequence
  Synthetic
cagtcatttgggctttcagtcggatgtt

SEQ ID NO: 6215 - DNA, 28 bp, Artificial Sequence
  Synthetic
cagtcatttgggtgtaaacatcctcgac

SEQ ID NO: 6216 - DNA, 28 bp, Artificial Sequence
  Synthetic
cagtcatttgggtgtaaacatcctacac

SEQ ID NO: 6217 - DNA, 28 bp, Artificial Sequence
  Synthetic
cagtcatttgggggcaagatgctggcat

SEQ ID NO: 6218 - DNA, 28 bp, Artificial Sequence
  Synthetic
cagtcatttgggtattgcacattactaa

SEQ ID NO: 6219 - DNA, 28 bp, Artificial Sequence
  Synthetic
cagtcatttggggtgcattgtagttgca

SEQ ID NO: 6220 - DNA, 28 bp, Artificial Sequence
  Synthetic
cagtcatttgggtggcagtgtcttagct

SEQ ID NO: 6221 - DNA, 28 bp, Artificial Sequence
  Synthetic
cagtcatttgggtattgcacttgtcccg

SEQ ID NO: 6222 - DNA, 28 bp, Artificial Sequence
  Synthetic
cagtcatttgggaaagtgctgttcgtgc

SEQ ID NO: 6223 - DNA, 28 bp, Artificial Sequence
  Synthetic
cagtcatttgggtttggcactagcacat

SEQ ID NO: 6224 - DNA, 28 bp, Artificial Sequence
  Synthetic
cagtcatttgggtgaggtagtaagttgt

SEQ ID NO: 6225 - DNA, 28 bp, Artificial Sequence
  Synthetic
cagtcatttgggaacccgtagatccgat

SEQ ID NO: 6226 - DNA, 28 bp, Artificial Sequence
  Synthetic
cagtcatttgggtgaggtagtaggttgt

SEQ ID NO: 6227 - DNA, 28 bp, Artificial Sequence
  Synthetic
cagtcatttgggtgaggtagtaggttgt

SEQ ID NO: 6228 - DNA, 28 bp, Artificial Sequence
  Synthetic
cagtcatttgggtgaggtagtaggttgt

SEQ ID NO: 6229 - DNA, 28 bp, Artificial Sequence
  Synthetic
cagtcatttgggagaggtagtaggttgc

SEQ ID NO: 6230 - DNA, 28 bp, Artificial Sequence
  Synthetic
cagtcatttgggctatacgacctgctgc

SEQ ID NO: 6231 - DNA, 28 bp, Artificial Sequence
  Synthetic
cagtcatttgggtgaggtaggaggttgt

SEQ ID NO: 6232 - DNA, 28 bp, Artificial Sequence
  Synthetic
cagtcatttgggtgaggtagtagattgt

SEQ ID NO: 6233 - DNA, 28 bp, Artificial Sequence
  Synthetic
cagtcatttgggtgaggtagtagtttgt

SEQ ID NO: 6234 - DNA, 28 bp, Artificial Sequence
  Synthetic
cagtcatttgggtgaggtagtagtttgt

SEQ ID NO: 6235 - DNA, 28 bp, Artificial Sequence
  Synthetic
cagtcatttgggtggaatgtaaagaagt

SEQ ID NO: 6236 - DNA, 28 bp, Artificial Sequence
  Synthetic
cagtcatttgggaacccgtagatccgaa

SEQ ID NO: 6237 - DNA, 28 bp, Artificial Sequence
  Synthetic
cagtcatttgggtacagtactgtgataa

SEQ ID NO: 6238 - DNA, 28 bp, Artificial Sequence
  Synthetic
cagtcatttgggtacagtactgtgatag

SEQ ID NO: 6239 - DNA, 28 bp, Artificial Sequence
  Synthetic
cagtcatttgggagcagcattgtacagg

SEQ ID NO: 6240 - DNA, 28 bp, Artificial Sequence
  Synthetic
cagtcatttgggcaaagtgctaacagtg

SEQ ID NO: 6241 - DNA, 28 bp, Artificial Sequence
  Synthetic
cagtcatttgggtaaagtgctgacagtg

SEQ ID NO: 6242 - DNA, 28 bp, Artificial Sequence
  Synthetic
cagtcatttgggagcagcattgtacagg

SEQ ID NO: 6243 - DNA, 28 bp, Artificial Sequence
  Synthetic
cagtcatttgggtaccctgtagatccga

SEQ ID NO: 6244 - DNA, 28 bp, Artificial Sequence
  Synthetic
cagtcatttgggccctgtagaaccgaat

SEQ ID NO: 6245 - DNA, 28 bp, Artificial Sequence
  Synthetic
cagtcatttgggtggagtgtgacaatgg

SEQ ID NO: 6246 - DNA, 28 bp, Artificial Sequence
  Synthetic
cagtcatttgggtaaggcacgcggtgaa

SEQ ID NO: 6247 - DNA, 28 bp, Artificial Sequence
  Synthetic
cagtcatttgggtccctgagacccttta

SEQ ID NO: 6248 - DNA, 28 bp, Artificial Sequence
  Synthetic
cagtcatttgggtccctgagaccctaac

SEQ ID NO: 6249 - DNA, 28 bp, Artificial Sequence
  Synthetic
cagtcatttgggtcgtaccgtgagtaat

SEQ ID NO: 6250 - DNA, 28 bp, Artificial Sequence
  Synthetic
cagtcatttgggcattattacttttggt

SEQ ID NO: 6251 - DNA, 28 bp, Artificial Sequence
  Synthetic
cagtcatttgggtcggatccgtctgagc

SEQ ID NO: 6252 - DNA, 28 bp, Artificial Sequence
  Synthetic
cagtcatttgggtcacagtgaaccggtc

SEQ ID NO: 6253 - DNA, 28 bp, Artificial Sequence
  Synthetic
cagtcatttgggtcacagtgaaccggtc

SEQ ID NO: 6254 - DNA, 28 bp, Artificial Sequence
  Synthetic
cagtcatttgggaagcccttaccccaaa

SEQ ID NO: 6255 - DNA, 28 bp, Artificial Sequence
  Synthetic
cagtcatttgggctttttgcggtctggg

SEQ ID NO: 6256 - DNA, 28 bp, Artificial Sequence
  Synthetic
cagtcatttgggcagtgcaatgttaaaa

SEQ ID NO: 6257 - DNA, 28 bp, Artificial Sequence
  Synthetic
cagtcatttgggcagtgcaatgatgaaa

SEQ ID NO: 6258 - DNA, 28 bp, Artificial Sequence
  Synthetic
cagtcatttgggtaacagtctacagcca

SEQ ID NO: 6259 - DNA, 28 bp, Artificial Sequence
  Synthetic
cagtcatttgggttggtccccttcaacc

SEQ ID NO: 6260 - DNA, 28 bp, Artificial Sequence
  Synthetic
cagtcatttggggctggtaaaatggaac

SEQ ID NO: 6261 - DNA, 28 bp, Artificial Sequence
  Synthetic
cagtcatttgggttggtccccttcaacc

SEQ ID NO: 6262 - DNA, 28 bp, Artificial Sequence
  Synthetic
cagtcatttgggtgtgactggttgacca

SEQ ID NO: 6263 - DNA, 28 bp, Artificial Sequence
  Synthetic
cagtcatttgggtatggctttttattcc

SEQ ID NO: 6264 - DNA, 28 bp, Artificial Sequence
  Synthetic
cagtcatttgggtatggcttttcattcc

SEQ ID NO: 6265 - DNA, 28 bp, Artificial Sequence
  Synthetic
cagtcatttgggactccatttgttttga

SEQ ID NO: 6266 - DNA, 28 bp, Artificial Sequence
  Synthetic
cagtcatttgggttattgcttaagaata

SEQ ID NO: 6267 - DNA, 28 bp, Artificial Sequence
  Synthetic
cagtcatttgggagctggtgttgtgaat

SEQ ID NO: 6268 - DNA, 28 bp, Artificial Sequence
  Synthetic
cagtcatttgggtctacagtgcacgtgt

SEQ ID NO: 6269 - DNA, 28 bp, Artificial Sequence
  Synthetic
cagtcatttgggcagtggttttacccta

SEQ ID NO: 6270 - DNA, 28 bp, Artificial Sequence
  Synthetic
cagtcatttgggtaccacagggtagaac

SEQ ID NO: 6271 - DNA, 28 bp, Artificial Sequence
  Synthetic
cagtcatttgggtaacactgtctggtaa

SEQ ID NO: 6272 - DNA, 28 bp, Artificial Sequence
  Synthetic
cagtcatttgggtgtagtgtttcctact

SEQ ID NO: 6273 - DNA, 28 bp, Artificial Sequence
  Synthetic
cagtcatttgggcataaagtagaaagca

SEQ ID NO: 6274 - DNA, 28 bp, Artificial Sequence
  Synthetic
cagtcatttgggtgagatgaagcactgt

SEQ ID NO: 6275 - DNA, 28 bp, Artificial Sequence
  Synthetic
cagtcatttgggtacagtatagatgatg

SEQ ID NO: 6276 - DNA, 28 bp, Artificial Sequence
  Synthetic
cagtcatttggggtccagttttcccagg

SEQ ID NO: 6277 - DNA, 28 bp, Artificial Sequence
  Synthetic
cagtcatttgggtgagaactgaattcca

SEQ ID NO: 6278 - DNA, 28 bp, Artificial Sequence
  Synthetic
cagtcatttgggtgagaactgaattcca

SEQ ID NO: 6279 - DNA, 28 bp, Artificial Sequence
  Synthetic
cagtcatttgggtcagtgcactacagaa

SEQ ID NO: 6280 - DNA, 28 bp, Artificial Sequence
  Synthetic
cagtcatttgggtcagtgcatcacagaa

SEQ ID NO: 6281 - DNA, 28 bp, Artificial Sequence
  Synthetic
cagtcatttgggtctggctccgtgtctt

SEQ ID NO: 6282 - DNA, 28 bp, Artificial Sequence
  Synthetic
cagtcatttgggtctcccaacccttgta

SEQ ID NO: 6283 - DNA, 28 bp, Artificial Sequence
  Synthetic
cagtcatttgggctagactgaggctcct

SEQ ID NO: 6284 - DNA, 28 bp, Artificial Sequence
  Synthetic
cagtcatttgggtcagtgcatgacagaa

SEQ ID NO: 6285 - DNA, 28 bp, Artificial Sequence
  Synthetic
cagtcatttgggttgcatagtcacaaaa

SEQ ID NO: 6286 - DNA, 28 bp, Artificial Sequence
  Synthetic
cagtcatttgggtaggttatccgtgttg

SEQ ID NO: 6287 - DNA, 28 bp, Artificial Sequence
  Synthetic
cagtcatttgggttaatgctaattgtga

SEQ ID NO: 6288 - DNA, 28 bp, Artificial Sequence
  Synthetic
cagtcatttgggtagcagcacataatgg

SEQ ID NO: 6289 - DNA, 28 bp, Artificial Sequence
  Synthetic
cagtcatttgggtagcagcacatcatgg

SEQ ID NO: 6290 - DNA, 28 bp, Artificial Sequence
  Synthetic
cagtcatttgggtagcagcacgtaaata

SEQ ID NO: 6291 - DNA, 28 bp, Artificial Sequence
  Synthetic
cagtcatttgggactgcagtgagggcac

SEQ ID NO: 6292 - DNA, 28 bp, Artificial Sequence
  Synthetic
cagtcatttgggcaaagtgcttacagtg

SEQ ID NO: 6293 - DNA, 28 bp, Artificial Sequence
  Synthetic
cagtcatttgggtaaggtgcatctagtg

SEQ ID NO: 6294 - DNA, 28 bp, Artificial Sequence
  Synthetic
cagtcatttgggaacattcaacgctgtc

SEQ ID NO: 6295 - DNA, 28 bp, Artificial Sequence
  Synthetic
cagtcatttgggaccatcgaccgttgat

SEQ ID NO: 6296 - DNA, 28 bp, Artificial Sequence
  Synthetic
cagtcatttgggaacattcattgctgtc

SEQ ID NO: 6297 - DNA, 28 bp, Artificial Sequence
  Synthetic
cagtcatttgggaacattcaacctgtcg

SEQ ID NO: 6298 - DNA, 28 bp, Artificial Sequence
  Synthetic
cagtcatttgggtttggcaatggtagaa

SEQ ID NO: 6299 - DNA, 28 bp, Artificial Sequence
  Synthetic
cagtcatttgggtatggcactggtagaa

SEQ ID NO: 6300 - DNA, 28 bp, Artificial Sequence
  Synthetic
cagtcatttgggtggacggagaactgat

SEQ ID NO: 6301 - DNA, 28 bp, Artificial Sequence
  Synthetic
cagtcatttgggtggagagaaaggcagt

SEQ ID NO: 6302 - DNA, 28 bp, Artificial Sequence
  Synthetic
cagtcatttgggcaaagaattctccttt

SEQ ID NO: 6303 - DNA, 28 bp, Artificial Sequence
  Synthetic
cagtcatttgggtcgtgtcttgtgttgc

SEQ ID NO: 6304 - DNA, 28 bp, Artificial Sequence
  Synthetic
cagtcatttgggcatcccttgcatggtg

SEQ ID NO: 6305 - DNA, 28 bp, Artificial Sequence
  Synthetic
cagtcatttggggtgcctactgagctga

SEQ ID NO: 6306 - DNA, 28 bp, Artificial Sequence
  Synthetic
cagtcatttgggtgatatgtttgatata

SEQ ID NO: 6307 - DNA, 28 bp, Artificial Sequence
  Synthetic
cagtcatttgggcaacggaatcccaaaa

SEQ ID NO: 6308 - DNA, 28 bp, Artificial Sequence
  Synthetic
cagtcatttgggctgacctatgaattga

SEQ ID NO: 6309 - DNA, 28 bp, Artificial Sequence
  Synthetic
cagtcatttgggaactggcctacaaagt

SEQ ID NO: 6310 - DNA, 28 bp, Artificial Sequence
  Synthetic
cagtcatttgggtgtaacagcaactcca

SEQ ID NO: 6311 - DNA, 28 bp, Artificial Sequence
  Synthetic
cagtcatttgggtagcagcacagaaata

SEQ ID NO: 6312 - DNA, 28 bp, Artificial Sequence
  Synthetic
cagtcatttgggtaggtagtttcatgtt

SEQ ID NO: 6313 - DNA, 28 bp, Artificial Sequence
  Synthetic
cagtcatttgggtaggtagtttcctgtt

SEQ ID NO: 6314 - DNA, 28 bp, Artificial Sequence
  Synthetic
cagtcatttgggcccagtgttcagacta

SEQ ID NO: 6315 - DNA, 28 bp, Artificial Sequence
  Synthetic
cagtcatttgggtacagtagtctgcaca

SEQ ID NO: 6316 - DNA, 28 bp, Artificial Sequence
  Synthetic
cagtcatttgggcccagtgtttagacta

SEQ ID NO: 6317 - DNA, 28 bp, Artificial Sequence
  Synthetic
cagtcatttgggtgtgcaaatctatgca

SEQ ID NO: 6318 - DNA, 28 bp, Artificial Sequence
  Synthetic
cagtcatttgggtgtgcaaatccatgca

SEQ ID NO: 6319 - DNA, 28 bp, Artificial Sequence
  Synthetic
cagtcatttgggtaacactgtctggtaa

SEQ ID NO: 6320 - DNA, 28 bp, Artificial Sequence
  Synthetic
cagtcatttgggtaatactgcctggtaa

SEQ ID NO: 6321 - DNA, 28 bp, Artificial Sequence
  Synthetic
cagtcatttgggtaatactgccgggtaa

SEQ ID NO: 6322 - DNA, 28 bp, Artificial Sequence
  Synthetic
cagtcatttgggtactcagtaaggcatt

SEQ ID NO: 6323 - DNA, 28 bp, Artificial Sequence
  Synthetic
cagtcatttgggagaggtatagcgcatg

SEQ ID NO: 6324 - DNA, 28 bp, Artificial Sequence
  Synthetic
cagtcatttgggtgaaatgtttaggacc

SEQ ID NO: 6325 - DNA, 28 bp, Artificial Sequence
  Synthetic
cagtcatttgggttccctttgtcatcct

SEQ ID NO: 6326 - DNA, 28 bp, Artificial Sequence
  Synthetic
cagtcatttgggtccttcattccaccgg

SEQ ID NO: 6327 - DNA, 28 bp, Artificial Sequence
  Synthetic
cagtcatttgggtggaatgtaaggaagt

SEQ ID NO: 6328 - DNA, 28 bp, Artificial Sequence
  Synthetic
cagtcatttggggcttctcctggctctc

SEQ ID NO: 6329 - DNA, 28 bp, Artificial Sequence
  Synthetic
cagtcatttgggataagacgagcaaaaa

SEQ ID NO: 6330 - DNA, 28 bp, Artificial Sequence
  Synthetic
cagtcatttgggtaaagtgcttatagtg

SEQ ID NO: 6331 - DNA, 28 bp, Artificial Sequence
  Synthetic
cagtcatttgggcaaagtgctcatagtg

SEQ ID NO: 6332 - DNA, 28 bp, Artificial Sequence
  Synthetic
cagtcatttgggtagcttatcagactga

SEQ ID NO: 6333 - DNA, 28 bp, Artificial Sequence
  Synthetic
cagtcatttgggctgtgcgtgtgacagc

SEQ ID NO: 6334 - DNA, 28 bp, Artificial Sequence
  Synthetic
cagtcatttgggttccctttgtcatcct

SEQ ID NO: 6335 - DNA, 28 bp, Artificial Sequence
  Synthetic
cagtcatttgggtaacagtctccagtca

SEQ ID NO: 6336 - DNA, 28 bp, Artificial Sequence
  Synthetic
cagtcatttgggacagcaggcacagaca

SEQ ID NO: 6337 - DNA, 28 bp, Artificial Sequence
  Synthetic
cagtcatttgggatgacctatgatttga

SEQ ID NO: 6338 - DNA, 28 bp, Artificial Sequence
  Synthetic
cagtcatttgggtaatctcagctggcaa

SEQ ID NO: 6339 - DNA, 28 bp, Artificial Sequence
  Synthetic
cagtcatttggggggaaatctctgcagg

SEQ ID NO: 6340 - DNA, 28 bp, Artificial Sequence
  Synthetic
cagtcatttgggtactgcatcaggaact

SEQ ID NO: 6341 - DNA, 28 bp, Artificial Sequence
  Synthetic
cagtcatttgggttgtgcttgatctaac

SEQ ID NO: 6342 - DNA, 28 bp, Artificial Sequence
  Synthetic
cagtcatttgggtgattgtccaaacgca

SEQ ID NO: 6343 - DNA, 28 bp, Artificial Sequence
  Synthetic
cagtcatttgggaagctgccagttgaag

SEQ ID NO: 6344 - DNA, 28 bp, Artificial Sequence
  Synthetic
cagtcatttgggagctacattgtctgct

SEQ ID NO: 6345 - DNA, 28 bp, Artificial Sequence
  Synthetic
cagtcatttgggagctacatctggctac

SEQ ID NO: 6346 - DNA, 28 bp, Artificial Sequence
  Synthetic
cagtcatttgggtgtcagtttgtcaaat

SEQ ID NO: 6347 - DNA, 28 bp, Artificial Sequence
  Synthetic
cagtcatttgggtaagtcactagtggtt

SEQ ID NO: 6348 - DNA, 28 bp, Artificial Sequence
  Synthetic
cagtcatttgggatcacattgccaggga

SEQ ID NO: 6349 - DNA, 28 bp, Artificial Sequence
  Synthetic
cagtcatttgggatcacattgccaggga

SEQ ID NO: 6350 - DNA, 28 bp, Artificial Sequence
  Synthetic
cagtcatttgggtggctcagttcagcag

SEQ ID NO: 6351 - DNA, 28 bp, Artificial Sequence
  Synthetic
cagtcatttgggcattgcacttgtctcg

SEQ ID NO: 6352 - DNA, 28 bp, Artificial Sequence
  Synthetic
cagtcatttgggttcaagtaatccagga

SEQ ID NO: 6353 - DNA, 28 bp, Artificial Sequence
  Synthetic
cagtcatttgggttcaagtaattcagga

SEQ ID NO: 6354 - DNA, 28 bp, Artificial Sequence
  Synthetic
cagtcatttgggttcacagtggctaagt

SEQ ID NO: 6355 - DNA, 28 bp, Artificial Sequence
  Synthetic
cagtcatttgggttcacagtggctaagt

SEQ ID NO: 6356 - DNA, 28 bp, Artificial Sequence
  Synthetic
cagtcatttgggaaggagctcacagtct

SEQ ID NO: 6357 - DNA, 28 bp, Artificial Sequence
  Synthetic
cagtcatttgggctcaaactatgggggc

SEQ ID NO: 6358 - DNA, 28 bp, Artificial Sequence
  Synthetic
cagtcatttgggaaagtgcttccacttt

SEQ ID NO: 6359 - DNA, 28 bp, Artificial Sequence
  Synthetic
cagtcatttgggcatcaaagtggaggcc

SEQ ID NO: 6360 - DNA, 28 bp, Artificial Sequence
  Synthetic
cagtcatttgggaaagtgcatccatttt

SEQ ID NO: 6361 - DNA, 28 bp, Artificial Sequence
  Synthetic
cagtcatttggggatcaaagtggaggcc

SEQ ID NO: 6362 - DNA, 28 bp, Artificial Sequence
  Synthetic
cagtcatttgggaagtgccgccaggttt

SEQ ID NO: 6363 - DNA, 28 bp, Artificial Sequence
  Synthetic
cagtcatttgggactcaaactgggggct

SEQ ID NO: 6364 - DNA, 28 bp, Artificial Sequence
  Synthetic
cagtcatttgggagtgccgcagagtttg

SEQ ID NO: 6365 - DNA, 28 bp, Artificial Sequence
  Synthetic
cagtcatttgggaaagtgcttccctttt

SEQ ID NO: 6366 - DNA, 28 bp, Artificial Sequence
  Synthetic
cagtcatttgggaaagtgctactacttt

SEQ ID NO: 6367 - DNA, 28 bp, Artificial Sequence
  Synthetic
cagtcatttgggagggccccccctcaat

SEQ ID NO: 6368 - DNA, 28 bp, Artificial Sequence
  Synthetic
cagtcatttgggatgtatgtgtgcatgt

SEQ ID NO: 6369 - DNA, 28 bp, Artificial Sequence
  Synthetic
cagtcatttgggatgtatgtgtgcatga

SEQ ID NO: 6370 - DNA, 28 bp, Artificial Sequence
  Synthetic
cagtcatttgggggcagaggagggctgt

SEQ ID NO: 6371 - DNA, 28 bp, Artificial Sequence
  Synthetic
cagtcatttgggtggtttaccgtcccac

SEQ ID NO: 6372 - DNA, 28 bp, Artificial Sequence
  Synthetic
cagtcatttgggtagcaccatctgaaat

SEQ ID NO: 6373 - DNA, 28 bp, Artificial Sequence
  Synthetic
cagtcatttgggtagcaccatttgaaat

SEQ ID NO: 6374 - DNA, 28 bp, Artificial Sequence
  Synthetic
cagtcatttgggtagcaccatttgaaat

SEQ ID NO: 6375 - DNA, 28 bp, Artificial Sequence
  Synthetic
cagtcatttgggtatgcaagggcaagct

SEQ ID NO: 6376 - DNA, 28 bp, Artificial Sequence
  Synthetic
cagtcatttgggcagtgcaatagtattg

SEQ ID NO: 6377 - DNA, 28 bp, Artificial Sequence
  Synthetic
cagtcatttgggcagtgcaatggtattg

SEQ ID NO: 6378 - DNA, 28 bp, Artificial Sequence
  Synthetic
cagtcatttgggtaagtgcttccatgtt

SEQ ID NO: 6379 - DNA, 28 bp, Artificial Sequence
  Synthetic
cagtcatttgggaagtgcttccatgttt

SEQ ID NO: 6380 - DNA, 28 bp, Artificial Sequence
  Synthetic
cagtcatttgggactttaacatgggaat

SEQ ID NO: 6381 - DNA, 28 bp, Artificial Sequence
  Synthetic
cagtcatttgggcaagtgcttccatgtt

SEQ ID NO: 6382 - DNA, 28 bp, Artificial Sequence
  Synthetic
cagtcatttgggtttaacatggggttac

SEQ ID NO: 6383 - DNA, 28 bp, Artificial Sequence
  Synthetic
cagtcatttgggaagtgcttccatgttt

SEQ ID NO: 6384 - DNA, 28 bp, Artificial Sequence
  Synthetic
cagtcatttgggctttcagtcggatgtt

SEQ ID NO: 6385 - DNA, 28 bp, Artificial Sequence
  Synthetic
cagtcatttgggtgtaaacatcctcgac

SEQ ID NO: 6386 - DNA, 28 bp, Artificial Sequence
  Synthetic
cagtcatttgggtgtaaacatcctacac

SEQ ID NO: 6387 - DNA, 28 bp, Artificial Sequence
  Synthetic
cagtcatttgggtgtaaacatcctacac

SEQ ID NO: 6388 - DNA, 28 bp, Artificial Sequence
  Synthetic
cagtcatttgggtgtaaacatccccgac

SEQ ID NO: 6389 - DNA, 28 bp, Artificial Sequence
  Synthetic
cagtcatttgggtgtaaacatccttgac

SEQ ID NO: 6390 - DNA, 28 bp, Artificial Sequence
  Synthetic
cagtcatttgggctttcagtcggatgtt

SEQ ID NO: 6391 - DNA, 28 bp, Artificial Sequence
  Synthetic
cagtcatttgggaggcaagatgctggca

SEQ ID NO: 6392 - DNA, 28 bp, Artificial Sequence
  Synthetic
cagtcatttgggtattgcacattactaa

SEQ ID NO: 6393 - DNA, 28 bp, Artificial Sequence
  Synthetic
cagtcatttgggaaaagctgggttgaga

SEQ ID NO: 6394 - DNA, 28 bp, Artificial Sequence
  Synthetic
cagtcatttgggaaacatgaagcgctgc

SEQ ID NO: 6395 - DNA, 28 bp, Artificial Sequence
  Synthetic
cagtcatttggggcacattacacggtcg

SEQ ID NO: 6396 - DNA, 28 bp, Artificial Sequence
  Synthetic
cagtcatttgggccactgccccaggtgc

SEQ ID NO: 6397 - DNA, 28 bp, Artificial Sequence
  Synthetic
cagtcatttgggcgcatcccctagggca

SEQ ID NO: 6398 - DNA, 28 bp, Artificial Sequence
  Synthetic
cagtcatttgggcctagtaggtgctcag

SEQ ID NO: 6399 - DNA, 28 bp, Artificial Sequence
  Synthetic
cagtcatttgggcctctgggcccttcct

SEQ ID NO: 6400 - DNA, 28 bp, Artificial Sequence
  Synthetic
cagtcatttgggctggccctctctgccc

SEQ ID NO: 6401 - DNA, 28 bp, Artificial Sequence
  Synthetic
cagtcatttgggaacacacccagctaac

SEQ ID NO: 6402 - DNA, 28 bp, Artificial Sequence
  Synthetic
cagtcatttggggtgcattgtagttgca

SEQ ID NO: 6403 - DNA, 28 bp, Artificial Sequence
  Synthetic
cagtcatttggggcaaagcacagggcct

SEQ ID NO: 6404 - DNA, 28 bp, Artificial Sequence
  Synthetic
cagtcatttggggcccctgggcctatcc

SEQ ID NO: 6405 - DNA, 28 bp, Artificial Sequence
  Synthetic
cagtcatttgggtcaagagcaataacga

SEQ ID NO: 6406 - DNA, 28 bp, Artificial Sequence
  Synthetic
cagtcatttgggttcagctcctatatga

SEQ ID NO: 6407 - DNA, 28 bp, Artificial Sequence
  Synthetic
cagtcatttgggtccagcatcagtgatt

SEQ ID NO: 6408 - DNA, 28 bp, Artificial Sequence
  Synthetic
cagtcatttgggtccctgtcctccagga

SEQ ID NO: 6409 - DNA, 28 bp, Artificial Sequence
  Synthetic
cagtcatttgggtccgtctcagttactt

SEQ ID NO: 6410 - DNA, 28 bp, Artificial Sequence
  Synthetic
cagtcatttgggtcgatcggtcggtcgg

SEQ ID NO: 6411 - DNA, 28 bp, Artificial Sequence
  Synthetic
cagtcatttgggtctcacacagaaatcg

SEQ ID NO: 6412 - DNA, 28 bp, Artificial Sequence
  Synthetic
cagtcatttgggtgatctagccaaagcc

SEQ ID NO: 6413 - DNA, 28 bp, Artificial Sequence
  Synthetic
cagtcatttgggtgctgacccctagtcc

SEQ ID NO: 6414 - DNA, 28 bp, Artificial Sequence
  Synthetic
cagtcatttgggtgtctgcccgagtgcc

SEQ ID NO: 6415 - DNA, 28 bp, Artificial Sequence
  Synthetic
cagtcatttgggtggcagtgtcttagct

SEQ ID NO: 6416 - DNA, 28 bp, Artificial Sequence
  Synthetic
cagtcatttgggtaggcagtgtaattag

SEQ ID NO: 6417 - DNA, 28 bp, Artificial Sequence
  Synthetic
cagtcatttgggaggcagtgtagttagc

SEQ ID NO: 6418 - DNA, 28 bp, Artificial Sequence
  Synthetic
cagtcatttgggttcacaaagcccatac

SEQ ID NO: 6419 - DNA, 28 bp, Artificial Sequence
  Synthetic
cagtcatttgggtccctgaggagccctt

SEQ ID NO: 6420 - DNA, 28 bp, Artificial Sequence
  Synthetic
cagtcatttgggttatcagaatctccag

SEQ ID NO: 6421 - DNA, 28 bp, Artificial Sequence
  Synthetic
cagtcatttgggaatccttggaacctag

SEQ ID NO: 6422 - DNA, 28 bp, Artificial Sequence
  Synthetic
cagtcatttgggattgcacggtatccat

SEQ ID NO: 6423 - DNA, 28 bp, Artificial Sequence
  Synthetic
cagtcatttgggtaatgcccctaaaaat

SEQ ID NO: 6424 - DNA, 28 bp, Artificial Sequence
  Synthetic
cagtcatttgggaattgcactttagcaa

SEQ ID NO: 6425 - DNA, 28 bp, Artificial Sequence
  Synthetic
cagtcatttgggaataatacatggttga

SEQ ID NO: 6426 - DNA, 28 bp, Artificial Sequence
  Synthetic
cagtcatttgggagatcgaccgtgttat

SEQ ID NO: 6427 - DNA, 28 bp, Artificial Sequence
  Synthetic
cagtcatttggggcctgctggggtggaa

SEQ ID NO: 6428 - DNA, 28 bp, Artificial Sequence
  Synthetic
cagtcatttgggggttgtattatcattg

SEQ ID NO: 6429 - DNA, 28 bp, Artificial Sequence
  Synthetic
cagtcatttgggatataatacaacctgc

SEQ ID NO: 6430 - DNA, 28 bp, Artificial Sequence
  Synthetic
cagtcatttgggtttgttcgttcggctc

SEQ ID NO: 6431 - DNA, 28 bp, Artificial Sequence
  Synthetic
cagtcatttgggatcgtagaggaaaatc

SEQ ID NO: 6432 - DNA, 28 bp, Artificial Sequence
  Synthetic
cagtcatttgggggtagattctccttct

SEQ ID NO: 6433 - DNA, 28 bp, Artificial Sequence
  Synthetic
cagtcatttgggatcatagaggaacatc

SEQ ID NO: 6434 - DNA, 28 bp, Artificial Sequence
  Synthetic
cagtcatttggggtggatattccttcta

SEQ ID NO: 6435 - DNA, 28 bp, Artificial Sequence
  Synthetic
cagtcatttgggaacatagaggaaattt

SEQ ID NO: 6436 - DNA, 28 bp, Artificial Sequence
  Synthetic
cagtcatttgggatcacacaaaggcaac

SEQ ID NO: 6437 - DNA, 28 bp, Artificial Sequence
  Synthetic
cagtcatttgggctcctgactccaggtc

SEQ ID NO: 6438 - DNA, 28 bp, Artificial Sequence
  Synthetic
cagtcatttgggtggtagactatggaac

SEQ ID NO: 6439 - DNA, 28 bp, Artificial Sequence
  Synthetic
cagtcatttgggtatgtagtatggtcca

SEQ ID NO: 6440 - DNA, 28 bp, Artificial Sequence
  Synthetic
cagtcatttgggtggttgaccatagaac

SEQ ID NO: 6441 - DNA, 28 bp, Artificial Sequence
  Synthetic
cagtcatttgggtatacaagggcaagct

SEQ ID NO: 6442 - DNA, 28 bp, Artificial Sequence
  Synthetic
cagtcatttggggaagttgttcgtggtg

SEQ ID NO: 6443 - DNA, 28 bp, Artificial Sequence
  Synthetic
cagtcatttgggagatcagaaggtgact

SEQ ID NO: 6444 - DNA, 28 bp, Artificial Sequence
  Synthetic
cagtcatttgggattcctagaaattgtt

SEQ ID NO: 6445 - DNA, 28 bp, Artificial Sequence
  Synthetic
cagtcatttggggaatgttgctcggtga

SEQ ID NO: 6446 - DNA, 28 bp, Artificial Sequence
  Synthetic
cagtcatttgggaatataacacagatgg

SEQ ID NO: 6447 - DNA, 28 bp, Artificial Sequence
  Synthetic
cagtcatttgggaacacggtccactaac

SEQ ID NO: 6448 - DNA, 28 bp, Artificial Sequence
  Synthetic
cagtcatttgggacttcacctggtccac

SEQ ID NO: 6449 - DNA, 28 bp, Artificial Sequence
  Synthetic
cagtcatttgggctggacttggagtcag

SEQ ID NO: 6450 - DNA, 28 bp, Artificial Sequence
  Synthetic
cagtcatttgggagctcggtctgaggcc

SEQ ID NO: 6451 - DNA, 28 bp, Artificial Sequence
  Synthetic
cagtcatttgggcagcagcaattcatgt

SEQ ID NO: 6452 - DNA, 28 bp, Artificial Sequence
  Synthetic
cagtcatttgggatcgggaatgtcgtgt

SEQ ID NO: 6453 - DNA, 28 bp, Artificial Sequence
  Synthetic
cagtcatttgggtaatactgtctggtaa

SEQ ID NO: 6454 - DNA, 28 bp, Artificial Sequence
  Synthetic
cagtcatttgggtgtcttgcaggccgtc

SEQ ID NO: 6455 - DNA, 28 bp, Artificial Sequence
  Synthetic
cagtcatttgggatcatgatgggctcct

SEQ ID NO: 6456 - DNA, 28 bp, Artificial Sequence
  Synthetic
cagtcatttgggtacggtgagcctgtca

SEQ ID NO: 6457 - DNA, 28 bp, Artificial Sequence
  Synthetic
cagtcatttgggtttgaaccatcactcg

SEQ ID NO: 6458 - DNA, 28 bp, Artificial Sequence
  Synthetic
cagtcatttgggagctcgactcatggtt

SEQ ID NO: 6459 - DNA, 28 bp, Artificial Sequence
  Synthetic
cagtcatttgggttgcatatgtaggatg

SEQ ID NO: 6460 - DNA, 28 bp, Artificial Sequence
  Synthetic
cagtcatttgggtggcagtgtattgtta

SEQ ID NO: 6461 - DNA, 28 bp, Artificial Sequence
  Synthetic
cagtcatttgggaggcagtgcattgcta

SEQ ID NO: 6462 - DNA, 28 bp, Artificial Sequence
  Synthetic
cagtcatttgggtttttgcgatgtgttc

SEQ ID NO: 6463 - DNA, 28 bp, Artificial Sequence
  Synthetic
cagtcatttgggttttgcagtatgttcc

SEQ ID NO: 6464 - DNA, 28 bp, Artificial Sequence
  Synthetic
cagtcatttgggattgggaacattttgc

SEQ ID NO: 6465 - DNA, 28 bp, Artificial Sequence
  Synthetic
cagtcatttgggaaaccgttaccattac

SEQ ID NO: 6466 - DNA, 28 bp, Artificial Sequence
  Synthetic
cagtcatttgggtgtttgcagaggaaac

SEQ ID NO: 6467 - DNA, 28 bp, Artificial Sequence
  Synthetic
cagtcatttgggatgcagtccacgggca

SEQ ID NO: 6468 - DNA, 28 bp, Artificial Sequence
  Synthetic
cagtcatttgggtatgtgcctttggact

SEQ ID NO: 6469 - DNA, 28 bp, Artificial Sequence
  Synthetic
cagtcatttgggtacctaatttgttgtc

SEQ ID NO: 6470 - DNA, 28 bp, Artificial Sequence
  Synthetic
cagtcatttgggtaccaagtttattctg

SEQ ID NO: 6471 - DNA, 28 bp, Artificial Sequence
  Synthetic
cagtcatttgggtatttagaatggcact

SEQ ID NO: 6472 - DNA, 28 bp, Artificial Sequence
  Synthetic
cagtcatttgggatacatacacgcacac

SEQ ID NO: 6473 - DNA, 28 bp, Artificial Sequence
  Synthetic
cagtcatttggggtaagtgcctgcatgt

SEQ ID NO: 6474 - DNA, 28 bp, Artificial Sequence
  Synthetic
cagtcatttgggatatacatacacacac

SEQ ID NO: 6475 - DNA, 28 bp, Artificial Sequence
  Synthetic
cagtcatttgggatatacatacacacac

SEQ ID NO: 6476 - DNA, 28 bp, Artificial Sequence
  Synthetic
cagtcatttgggtatgactgatgtgcgt

SEQ ID NO: 6477 - DNA, 28 bp, Artificial Sequence
  Synthetic
cagtcatttgggtgcctctttcattgat

SEQ ID NO: 6478 - DNA, 28 bp, Artificial Sequence
  Synthetic
cagtcatttgggttcttggactggcact

SEQ ID NO: 6479 - DNA, 28 bp, Artificial Sequence
  Synthetic
cagtcatttgggtacgtagtatagtgct

SEQ ID NO: 6480 - DNA, 28 bp, Artificial Sequence
  Synthetic
cagtcatttgggtcactcctcccctccc

SEQ ID NO: 6481 - DNA, 28 bp, Artificial Sequence
  Synthetic
cagtcatttgggtcaggctcagtcccct

SEQ ID NO: 6482 - DNA, 28 bp, Artificial Sequence
  Synthetic
cagtcatttgggagtcatacacggctct

SEQ ID NO: 6483 - DNA, 28 bp, Artificial Sequence
  Synthetic
cagtcatttgggagaggctggccgtgat

SEQ ID NO: 6484 - DNA, 28 bp, Artificial Sequence
  Synthetic
cagtcatttgggtcctgtactgagctgc

SEQ ID NO: 6485 - DNA, 28 bp, Artificial Sequence
  Synthetic
cagtcatttgggaatcgtacagggtcat

SEQ ID NO: 6486 - DNA, 28 bp, Artificial Sequence
  Synthetic
cagtcatttgggcccagataatagcact

SEQ ID NO: 6487 - DNA, 28 bp, Artificial Sequence
  Synthetic
cagtcatttgggttgaaaggctgtttct

SEQ ID NO: 6488 - DNA, 28 bp, Artificial Sequence
  Synthetic
cagtcatttgggaatgacaccacatata

SEQ ID NO: 6489 - DNA, 28 bp, Artificial Sequence
  Synthetic
cagtcatttgggcaacctggaggactcc

SEQ ID NO: 6490 - DNA, 28 bp, Artificial Sequence
  Synthetic
cagtcatttgggagtggggaacccttcc

SEQ ID NO: 6491 - DNA, 28 bp, Artificial Sequence
  Synthetic
cagtcatttgggtgaaacatacacggga

SEQ ID NO: 6492 - DNA, 28 bp, Artificial Sequence
  Synthetic
cagtcatttgggaaacaaacatggtgca

SEQ ID NO: 6493 - DNA, 28 bp, Artificial Sequence
  Synthetic
cagtcatttgggtgagtattacatggcc

SEQ ID NO: 6494 - DNA, 28 bp, Artificial Sequence
  Synthetic
cagtcatttgggcagcagcacactgtgg

SEQ ID NO: 6495 - DNA, 28 bp, Artificial Sequence
  Synthetic
cagtcatttgggttaagacttgcagtga

SEQ ID NO: 6496 - DNA, 28 bp, Artificial Sequence
  Synthetic
cagtcatttgggatgcacctgggcaagg

SEQ ID NO: 6497 - DNA, 28 bp, Artificial Sequence
  Synthetic
cagtcatttgggaatcctttgtccctgg

SEQ ID NO: 6498 - DNA, 28 bp, Artificial Sequence
  Synthetic
cagtcatttgggaatgcacccgggcaag

SEQ ID NO: 6499 - DNA, 28 bp, Artificial Sequence
  Synthetic
cagtcatttgggtagcagcgggaacagt

SEQ ID NO: 6500 - DNA, 28 bp, Artificial Sequence
  Synthetic
cagtcatttgggcgtcaacacttgctgg

SEQ ID NO: 6501 - DNA, 28 bp, Artificial Sequence
  Synthetic
cagtcatttgggcatgccttgagtgtag

SEQ ID NO: 6502 - DNA, 28 bp, Artificial Sequence
  Synthetic
cagtcatttgggggagaaattatccttg

SEQ ID NO: 6503 - DNA, 28 bp, Artificial Sequence
  Synthetic
cagtcatttgggaggtcagaggtcgatc

SEQ ID NO: 6504 - DNA, 28 bp, Artificial Sequence
  Synthetic
cagtcatttgggaagggattctgatgtt

SEQ ID NO: 6505 - DNA, 28 bp, Artificial Sequence
  Synthetic
cagtcatttgggtgtgacagattgataa

SEQ ID NO: 6506 - DNA, 28 bp, Artificial Sequence
  Synthetic
cagtcatttgggctcggggatcatcatg

SEQ ID NO: 6507 - DNA, 28 bp, Artificial Sequence
  Synthetic
cagtcatttgggaaacattcgcggtgca

SEQ ID NO: 6508 - DNA, 28 bp, Artificial Sequence
  Synthetic
cagtcatttgggatggtggcacggagtc

SEQ ID NO: 6509 - DNA, 28 bp, Artificial Sequence
  Synthetic
cagtcatttgggcttggtacatctttga

SEQ ID NO: 6510 - DNA, 28 bp, Artificial Sequence
  Synthetic
cagtcatttgggcgacccatacttggtt

SEQ ID NO: 6511 - DNA, 28 bp, Artificial Sequence
  Synthetic
cagtcatttgggattgtgtcaatatgcg

SEQ ID NO: 6512 - DNA, 28 bp, Artificial Sequence
  Synthetic
cagtcatttgggtccgagcctgggtctc

SEQ ID NO: 6513 - DNA, 28 bp, Artificial Sequence
  Synthetic
cagtcatttgggaatggcgccactaggg

SEQ ID NO: 6514 - DNA, 28 bp, Artificial Sequence
  Synthetic
cagtcatttgggaccaggaggctgaggt

SEQ ID NO: 6515 - DNA, 28 bp, Artificial Sequence
  Synthetic
cagtcatttgggagcgggcacagctgtg

SEQ ID NO: 6516 - DNA, 28 bp, Artificial Sequence
  Synthetic
cagtcatttgggtgacacctgccaccca

SEQ ID NO: 6517 - DNA, 28 bp, Artificial Sequence
  Synthetic
cagtcatttgggtgtcactcggctcggc

SEQ ID NO: 6518 - DNA, 28 bp, Artificial Sequence
  Synthetic
cagtcatttgggagttgtgtgtgcatgt

SEQ ID NO: 6519 - DNA, 28 bp, Artificial Sequence
  Synthetic
cagtcatttgggagttttgtgtgcatgt

SEQ ID NO: 6520 - DNA, 28 bp, Artificial Sequence
  Synthetic
cagtcatttgggatagttgtgtgtggat

SEQ ID NO: 6521 - DNA, 28 bp, Artificial Sequence
  Synthetic
cagtcatttgggatccctgagtgtatgt

SEQ ID NO: 6522 - DNA, 28 bp, Artificial Sequence
  Synthetic
cagtcatttgggaggaagccctggaggg

SEQ ID NO: 6523 - DNA, 28 bp, Artificial Sequence
  Synthetic
cagtcatttgggtgaggttggtgtactg

SEQ ID NO: 6524 - DNA, 28 bp, Artificial Sequence
  Synthetic
cagtcatttgggctcacagctctggtcc

SEQ ID NO: 6525 - DNA, 28 bp, Artificial Sequence
  Synthetic
cagtcatttggggcactgagatgggagt

SEQ ID NO: 6526 - DNA, 28 bp, Artificial Sequence
  Synthetic
cagtcatttgggcacagctcccatctca

SEQ ID NO: 6527 - DNA, 28 bp, Artificial Sequence
  Synthetic
cagtcatttgggctgtatgccctaaccg

SEQ ID NO: 6528 - DNA, 28 bp, Artificial Sequence
  Synthetic
cagtcatttgggtggtgcggaaagggcc

SEQ ID NO: 6529 - DNA, 28 bp, Artificial Sequence
  Synthetic
cagtcatttgggccgtcctgaggttgtt

SEQ ID NO: 6530 - DNA, 28 bp, Artificial Sequence
  Synthetic
cagtcatttgggactctacaaccttagg

SEQ ID NO: 6531 - DNA, 28 bp, Artificial Sequence
  Synthetic
cagtcatttgggttcagtgatgattagc

SEQ ID NO: 6532 - DNA, 28 bp, Artificial Sequence
  Synthetic
cagtcatttggggtctcggtgcaaggac

SEQ ID NO: 6533 - DNA, 28 bp, Artificial Sequence
  Synthetic
cagtcatttgggggactgtgaggtgact

SEQ ID NO: 6534 - DNA, 28 bp, Artificial Sequence
  Synthetic
cagtcatttggggggcatctgctgacat

SEQ ID NO: 6535 - DNA, 28 bp, Artificial Sequence
  Synthetic
cagtcatttgggcagcctcgctggcagg

SEQ ID NO: 6536 - DNA, 28 bp, Artificial Sequence
  Synthetic
cagtcatttgggctgcagtcacagtgaa

SEQ ID NO: 6537 - DNA, 28 bp, Artificial Sequence
  Synthetic
cagtcatttgggcctgctgtaagctgtg

SEQ ID NO: 6538 - DNA, 28 bp, Artificial Sequence
  Synthetic
cagtcatttgggagttttcccttcaagt

SEQ ID NO: 6539 - DNA, 28 bp, Artificial Sequence
  Synthetic
cagtcatttgggtcaatggctgaggtga

SEQ ID NO: 6540 - DNA, 28 bp, Artificial Sequence
  Synthetic
cagtcatttgggattgcttcccagacgg

SEQ ID NO: 6541 - DNA, 28 bp, Artificial Sequence
  Synthetic
cagtcatttgggctatcctggaatgcag

SEQ ID NO: 6542 - DNA, 28 bp, Artificial Sequence
  Synthetic
cagtcatttgggtcgcaggcgactactt

SEQ ID NO: 6543 - DNA, 28 bp, Artificial Sequence
  Synthetic
cagtcatttgggcgtccccgctcggcgg

SEQ ID NO: 6544 - DNA, 28 bp, Artificial Sequence
  Synthetic
cagtcatttgggaaaggctaggctcaca

SEQ ID NO: 6545 - DNA, 28 bp, Artificial Sequence
  Synthetic
cagtcatttgggattcctgaagagaggc

SEQ ID NO: 6546 - DNA, 28 bp, Artificial Sequence
  Synthetic
cagtcatttgggatctctttgagcgcct

SEQ ID NO: 6547 - DNA, 28 bp, Artificial Sequence
  Synthetic
cagtcatttggggcagctttcagatgtg

SEQ ID NO: 6548 - DNA, 28 bp, Artificial Sequence
  Synthetic
cagtcatttgggcagccacatccgaaag

SEQ ID NO: 6549 - DNA, 28 bp, Artificial Sequence
  Synthetic
cagtcatttgggctgaaaatgttgcctg

SEQ ID NO: 6550 - DNA, 28 bp, Artificial Sequence
  Synthetic
cagtcatttgggagattgggcataggtg

SEQ ID NO: 6551 - DNA, 28 bp, Artificial Sequence
  Synthetic
cagtcatttggggcgtgtgcttgctgtg

SEQ ID NO: 6552 - DNA, 28 bp, Artificial Sequence
  Synthetic
cagtcatttgggaacatcctggtcctgt

SEQ ID NO: 6553 - DNA, 28 bp, Artificial Sequence
  Synthetic
cagtcatttgggcattctcgtttccttc

SEQ ID NO: 6554 - DNA, 28 bp, Artificial Sequence
  Synthetic
cagtcatttgggaggcagtgcgacctgg

SEQ ID NO: 6555 - DNA, 28 bp, Artificial Sequence
  Synthetic
cagtcatttgggtggaagactagtgatt

SEQ ID NO: 6556 - DNA, 28 bp, Artificial Sequence
  Synthetic
cagtcatttgggcacgcgggaaccgagt

SEQ ID NO: 6557 - DNA, 28 bp, Artificial Sequence
  Synthetic
cagtcatttgggttagccgctgaaatag

SEQ ID NO: 6558 - DNA, 28 bp, Artificial Sequence
  Synthetic
cagtcatttgggtgcccaccctttaccc

SEQ ID NO: 6559 - DNA, 28 bp, Artificial Sequence
  Synthetic
cagtcatttgggaaaaccttcagaagga

SEQ ID NO: 6560 - DNA, 28 bp, Artificial Sequence
  Synthetic
cagtcatttgggagacatgtgctctgct

SEQ ID NO: 6561 - DNA, 28 bp, Artificial Sequence
  Synthetic
cagtcatttgggggtgggaggtggggtg

SEQ ID NO: 6562 - DNA, 28 bp, Artificial Sequence
  Synthetic
cagtcatttgggagagaaaccctgtctc

SEQ ID NO: 6563 - DNA, 28 bp, Artificial Sequence
  Synthetic
cagtcatttgggcagtcatgccgcttgc

SEQ ID NO: 6564 - DNA, 28 bp, Artificial Sequence
  Synthetic
cagtcatttgggcaactagactgtgagc

SEQ ID NO: 6565 - DNA, 28 bp, Artificial Sequence
  Synthetic
cagtcatttgggggaggcagaggcagga

SEQ ID NO: 6566 - DNA, 28 bp, Artificial Sequence
  Synthetic
cagtcatttgggccaagtcttggggaga

SEQ ID NO: 6567 - DNA, 28 bp, Artificial Sequence
  Synthetic
cagtcatttggggggacccggggagaga

SEQ ID NO: 6568 - DNA, 28 bp, Artificial Sequence
  Synthetic
cagtcatttgggctccttcacccgggcg

SEQ ID NO: 6569 - DNA, 28 bp, Artificial Sequence
  Synthetic
cagtcatttgggtgcgagtcacccccgg

SEQ ID NO: 6570 - DNA, 28 bp, Artificial Sequence
  Synthetic
cagtcatttgggtgcactgaaggcacac

SEQ ID NO: 6571 - DNA, 28 bp, Artificial Sequence
  Synthetic
cagtcatttgggcgacgagggccggtcg

SEQ ID NO: 6572 - DNA, 28 bp, Artificial Sequence
  Synthetic
cagtcatttgggctccgtgcacaccccc

SEQ ID NO: 6573 - DNA, 28 bp, Artificial Sequence
  Synthetic
cagtcatttgggctcagacagagatacc

SEQ ID NO: 6574 - DNA, 28 bp, Artificial Sequence
  Synthetic
cagtcatttgggcttccgcccggccggg

SEQ ID NO: 6575 - DNA, 28 bp, Artificial Sequence
  Synthetic
cagtcatttgggatctcggctacagaaa

SEQ ID NO: 6576 - DNA, 28 bp, Artificial Sequence
  Synthetic
cagtcatttgggatctcgctggggcctc

SEQ ID NO: 6577 - DNA, 28 bp, Artificial Sequence
  Synthetic
cagtcatttgggcagtgcaattaaaagg

SEQ ID NO: 6578 - DNA, 28 bp, Artificial Sequence
  Synthetic
cagtcatttgggtgcggggctagggcta

SEQ ID NO: 6579 - DNA, 28 bp, Artificial Sequence
  Synthetic
cagtcatttgggtttgtgacctggtcca

SEQ ID NO: 6580 - DNA, 28 bp, Artificial Sequence
  Synthetic
cagtcatttggggcagagtgcaaacaat

SEQ ID NO: 6581 - DNA, 28 bp, Artificial Sequence
  Synthetic
cagtcatttggggaaattcggctctggg

SEQ ID NO: 6582 - DNA, 28 bp, Artificial Sequence
  Synthetic
cagtcatttggggcagcagggtgaaact

SEQ ID NO: 6583 - DNA, 28 bp, Artificial Sequence
  Synthetic
cagtcatttgggggggctggggccggga

SEQ ID NO: 6584 - DNA, 28 bp, Artificial Sequence
  Synthetic
cagtcatttgggccagctgggaagaacc

SEQ ID NO: 6585 - DNA, 28 bp, Artificial Sequence
  Synthetic
cagtcatttgggaggaggccatagtggc

SEQ ID NO: 6586 - DNA, 28 bp, Artificial Sequence
  Synthetic
cagtcatttgggggtgctcacatgtcct

SEQ ID NO: 6587 - DNA, 28 bp, Artificial Sequence
  Synthetic
cagtcatttgggcgtgggcctgacgtgg

SEQ ID NO: 6588 - DNA, 28 bp, Artificial Sequence
  Synthetic
cagtcatttgggtggaagacttgtgatt

SEQ ID NO: 6589 - DNA, 28 bp, Artificial Sequence
  Synthetic
cagtcatttggggattgctgtgcgtgcg

SEQ ID NO: 6590 - DNA, 28 bp, Artificial Sequence
  Synthetic
cagtcatttgggtcagtaacaaagattc

SEQ ID NO: 6591 - DNA, 28 bp, Artificial Sequence
  Synthetic
cagtcatttgggtgtgagttgttcctca

SEQ ID NO: 6592 - DNA, 28 bp, Artificial Sequence
  Synthetic
cagtcatttggggaattgatcaggacat

SEQ ID NO: 6593 - DNA, 28 bp, Artificial Sequence
  Synthetic
cagtcatttgggtctttggttatctagc

SEQ ID NO: 6594 - DNA, 28 bp, Artificial Sequence
  Synthetic
cagtcatttgggtaaagctagataaccg

SEQ ID NO: 6595 - DNA, 28 bp, Artificial Sequence
  Synthetic
cagtcatttgggtattgcacttgtcccg

SEQ ID NO: 6596 - DNA, 28 bp, Artificial Sequence
  Synthetic
cagtcatttgggcaaagtgctgttcgtg

SEQ ID NO: 6597 - DNA, 28 bp, Artificial Sequence
  Synthetic
cagtcatttgggtttggcactagcacat

SEQ ID NO: 6598 - DNA, 28 bp, Artificial Sequence
  Synthetic
cagtcatttgggtgaggtagtaagttgt

SEQ ID NO: 6599 - DNA, 28 bp, Artificial Sequence
  Synthetic
cagtcatttgggacccgtagatccgatc

SEQ ID NO: 6600 - DNA, 28 bp, Artificial Sequence
  Synthetic
cagtcatttgggcacccgtagaaccgac

SEQ ID NO: 6601 - DNA, 28 bp, Artificial Sequence
  Synthetic
cagtcatttgggtacagtactgtgataa

SEQ ID NO: 6602 - DNA, 28 bp, Artificial Sequence
  Synthetic
cagtcatttgggagcagcattgtacagg

SEQ ID NO: 6603 - DNA, 28 bp, Artificial Sequence
  Synthetic
cagtcatttgggtcaaatgctcagactc

SEQ ID NO: 6604 - DNA, 28 bp, Artificial Sequence
  Synthetic
cagtcatttgggaaaagtgcttacagtg

SEQ ID NO: 6605 - DNA, 28 bp, Artificial Sequence
  Synthetic
cagtcatttgggtaaagtgctgacagtg

SEQ ID NO: 6606 - DNA, 28 bp, Artificial Sequence
  Synthetic
cagtcatttgggagcagcattgtacagg

SEQ ID NO: 6607 - DNA, 28 bp, Artificial Sequence
  Synthetic
cagtcatttgggtaccctgtagaaccga

SEQ ID NO: 6608 - DNA, 28 bp, Artificial Sequence
  Synthetic
cagtcatttgggtccctgagaccctaac

SEQ ID NO: 6609 - DNA, 28 bp, Artificial Sequence
  Synthetic
cagtcatttgggtcggatccgtctgagc

SEQ ID NO: 6610 - DNA, 28 bp, Artificial Sequence
  Synthetic
cagtcatttgggcagtgcaatgttaaaa

SEQ ID NO: 6611 - DNA, 28 bp, Artificial Sequence
  Synthetic
cagtcatttgggttggtccccttcaacc

SEQ ID NO: 6612 - DNA, 28 bp, Artificial Sequence
  Synthetic
cagtcatttgggtgtgactggttgacca

SEQ ID NO: 6613 - DNA, 28 bp, Artificial Sequence
  Synthetic
cagtcatttgggagtggttctaccctat

SEQ ID NO: 6614 - DNA, 28 bp, Artificial Sequence
  Synthetic
cagtcatttgggtacagtatagatgatg

SEQ ID NO: 6615 - DNA, 28 bp, Artificial Sequence
  Synthetic
cagtcatttggggtccagttttcccagg

SEQ ID NO: 6616 - DNA, 28 bp, Artificial Sequence
  Synthetic
cagtcatttggggtgtgtggaaatgctt

SEQ ID NO: 6617 - DNA, 28 bp, Artificial Sequence
  Synthetic
cagtcatttgggttgcatagtcacaaaa

SEQ ID NO: 6618 - DNA, 28 bp, Artificial Sequence
  Synthetic
cagtcatttgggtaggttatccgtgttg

SEQ ID NO: 6619 - DNA, 28 bp, Artificial Sequence
  Synthetic
cagtcatttgggtagcagcacataatgg

SEQ ID NO: 6620 - DNA, 28 bp, Artificial Sequence
  Synthetic
cagtcatttgggtagcagcacatcatgg

SEQ ID NO: 6621 - DNA, 28 bp, Artificial Sequence
  Synthetic
cagtcatttgggtagcagcacgtaaata

SEQ ID NO: 6622 - DNA, 28 bp, Artificial Sequence
  Synthetic
cagtcatttgggactgcagtgaaggcac

SEQ ID NO: 6623 - DNA, 28 bp, Artificial Sequence
  Synthetic
cagtcatttgggcaaagtgcttacagtg

SEQ ID NO: 6624 - DNA, 28 bp, Artificial Sequence
  Synthetic
cagtcatttgggtaaggtgcatctagtg

SEQ ID NO: 6625 - DNA, 28 bp, Artificial Sequence
  Synthetic
cagtcatttgggaacattcaacgctgtc

SEQ ID NO: 6626 - DNA, 28 bp, Artificial Sequence
  Synthetic
cagtcatttgggaccatcgaccgttgat

SEQ ID NO: 6627 - DNA, 28 bp, Artificial Sequence
  Synthetic
cagtcatttgggaacattcattgctgtc

SEQ ID NO: 6628 - DNA, 28 bp, Artificial Sequence
  Synthetic
cagtcatttgggtatggcactggtagaa

SEQ ID NO: 6629 - DNA, 28 bp, Artificial Sequence
  Synthetic
cagtcatttgggtggacggagaactgat

SEQ ID NO: 6630 - DNA, 28 bp, Artificial Sequence
  Synthetic
cagtcatttgggtcgtgtcttgtgttgc

SEQ ID NO: 6631 - DNA, 28 bp, Artificial Sequence
  Synthetic
cagtcatttgggcatcccttgcatggtg

SEQ ID NO: 6632 - DNA, 28 bp, Artificial Sequence
  Synthetic
cagtcatttggggtgcctactgagctga

SEQ ID NO: 6633 - DNA, 28 bp, Artificial Sequence
  Synthetic
cagtcatttgggtgtaacagcaactcca

SEQ ID NO: 6634 - DNA, 28 bp, Artificial Sequence
  Synthetic
cagtcatttgggttcaccaccttctcca

SEQ ID NO: 6635 - DNA, 28 bp, Artificial Sequence
  Synthetic
cagtcatttgggggtccagaggggaaat

SEQ ID NO: 6636 - DNA, 28 bp, Artificial Sequence
  Synthetic
cagtcatttgggcccagtgttcagacta

SEQ ID NO: 6637 - DNA, 28 bp, Artificial Sequence
  Synthetic
cagtcatttgggtgtgcaaatctatgca

SEQ ID NO: 6638 - DNA, 28 bp, Artificial Sequence
  Synthetic
cagtcatttgggtgtgcaaatccatgca

SEQ ID NO: 6639 - DNA, 28 bp, Artificial Sequence
  Synthetic
cagtcatttgggtaaagtgcttatagtg

SEQ ID NO: 6640 - DNA, 28 bp, Artificial Sequence
  Synthetic
cagtcatttgggttccctttgtcatcct

SEQ ID NO: 6641 - DNA, 28 bp, Artificial Sequence
  Synthetic
cagtcatttgggtccttcattccaccgg

SEQ ID NO: 6642 - DNA, 28 bp, Artificial Sequence
  Synthetic
cagtcatttgggtggaatgtaaggaagt

SEQ ID NO: 6643 - DNA, 28 bp, Artificial Sequence
  Synthetic
cagtcatttgggtagcttatcagactga

SEQ ID NO: 6644 - DNA, 28 bp, Artificial Sequence
  Synthetic
cagtcatttgggttccctttgtcatcct

SEQ ID NO: 6645 - DNA, 28 bp, Artificial Sequence
  Synthetic
cagtcatttgggacagcaggcacagaca

SEQ ID NO: 6646 - DNA, 28 bp, Artificial Sequence
  Synthetic
cagtcatttgggatgacctatgaattga

SEQ ID NO: 6647 - DNA, 28 bp, Artificial Sequence
  Synthetic
cagtcatttgggttgtgcttgatctaac

SEQ ID NO: 6648 - DNA, 28 bp, Artificial Sequence
  Synthetic
cagtcatttgggaagctgccagttgaag

SEQ ID NO: 6649 - DNA, 28 bp, Artificial Sequence
  Synthetic
cagtcatttgggccaccaccatgtctga

SEQ ID NO: 6650 - DNA, 28 bp, Artificial Sequence
  Synthetic
cagtcatttgggcaagtcactagtggtt

SEQ ID NO: 6651 - DNA, 28 bp, Artificial Sequence
  Synthetic
cagtcatttgggatcacattgccaggga

SEQ ID NO: 6652 - DNA, 28 bp, Artificial Sequence
  Synthetic
cagtcatttgggtggctcagttcagcag

SEQ ID NO: 6653 - DNA, 28 bp, Artificial Sequence
  Synthetic
cagtcatttgggcattgcacttgtctcg

SEQ ID NO: 6654 - DNA, 28 bp, Artificial Sequence
  Synthetic
cagtcatttgggttcaagtaatccagga

SEQ ID NO: 6655 - DNA, 28 bp, Artificial Sequence
  Synthetic
cagtcatttgggttcacagtggctaagt

SEQ ID NO: 6656 - DNA, 28 bp, Artificial Sequence
  Synthetic
cagtcatttgggaaggagctcacagtct

SEQ ID NO: 6657 - DNA, 28 bp, Artificial Sequence
  Synthetic
cagtcatttgggctagcaccatctgaaa

SEQ ID NO: 6658 - DNA, 28 bp, Artificial Sequence
  Synthetic
cagtcatttgggtagcaccatttgaaat

SEQ ID NO: 6659 - DNA, 28 bp, Artificial Sequence
  Synthetic
cagtcatttgggtgtaaacatcctacac

SEQ ID NO: 6660 - DNA, 28 bp, Artificial Sequence
  Synthetic
cagtcatttgggtgtaaacatcctacac

SEQ ID NO: 6661 - DNA, 28 bp, Artificial Sequence
  Synthetic
cagtcatttgggtgtaaacatccccgac

SEQ ID NO: 6662 - DNA, 28 bp, Artificial Sequence
  Synthetic
cagtcatttgggggcaagatgctggcat

SEQ ID NO: 6663 - DNA, 28 bp, Artificial Sequence
  Synthetic
cagtcatttgggtattgcacattactaa

SEQ ID NO: 6664 - DNA, 28 bp, Artificial Sequence
  Synthetic
cagtcatttggggtgcattgtagttgca

SEQ ID NO: 6665 - DNA, 28 bp, Artificial Sequence
  Synthetic
cagtcatttgggtggcagtgtcttagct

SEQ ID NO: 6666 - DNA, 28 bp, Artificial Sequence
  Synthetic
cagtcatttgggtggaagactagtgatt

SEQ ID NO: 6667 - DNA, 28 bp, Artificial Sequence
  Synthetic
cagtcatttgggtctttggttatctagc

SEQ ID NO: 6668 - DNA, 28 bp, Artificial Sequence
  Synthetic
cagtcatttgggtattgcacttgtcccg

SEQ ID NO: 6669 - DNA, 28 bp, Artificial Sequence
  Synthetic
cagtcatttgggaaagtgctgttcgtgc

SEQ ID NO: 6670 - DNA, 28 bp, Artificial Sequence
  Synthetic
cagtcatttgggtttggcactagcacat

SEQ ID NO: 6671 - DNA, 28 bp, Artificial Sequence
  Synthetic
cagtcatttgggaacccgtagatccgat

SEQ ID NO: 6672 - DNA, 28 bp, Artificial Sequence
  Synthetic
cagtcatttgggtgacagaagagagaga

SEQ ID NO: 6673 - DNA, 28 bp, Artificial Sequence
  Synthetic
cagtcatttgggtgcctggctccctgta

SEQ ID NO: 6674 - DNA, 28 bp, Artificial Sequence
  Synthetic
cagtcatttgggtcgataaacctctgca

SEQ ID NO: 6675 - DNA, 28 bp, Artificial Sequence
  Synthetic
cagtcatttgggtcggaccaggcttcat

SEQ ID NO: 6676 - DNA, 28 bp, Artificial Sequence
  Synthetic
cagtcatttgggcagccaaggatgactt

SEQ ID NO: 6677 - DNA, 28 bp, Artificial Sequence
  Synthetic
cagtcatttgggcagccaaggatgactt

SEQ ID NO: 6678 - DNA, 28 bp, Artificial Sequence
  Synthetic
cagtcatttgggtgattgagtcgtgcca

SEQ ID NO: 6679 - DNA, 28 bp, Artificial Sequence
  Synthetic
cagtcatttgggttggactgaagggagc

SEQ ID NO: 6680 - DNA, 28 bp, Artificial Sequence
  Synthetic
cagtcatttgggtccaaagggatcgcat

SEQ ID NO: 6681 - DNA, 28 bp, Artificial Sequence
  Synthetic
cagtcatttgggatgaagtgtttggggg

SEQ ID NO: 6682 - DNA, 28 bp, Artificial Sequence
  Synthetic
cagtcatttgggatgaagtatttggggg

SEQ ID NO: 6683 - DNA, 28 bp, Artificial Sequence
  Synthetic
cagtcatttgggatgaagtgtttggggg

SEQ ID NO: 6684 - DNA, 28 bp, Artificial Sequence
  Synthetic
cagtcatttgggatgaagtgtttggggg

SEQ ID NO: 6685 - DNA, 28 bp, Artificial Sequence
  Synthetic
cagtcatttgggatgaagtgtttggggg

SEQ ID NO: 6686 - DNA, 28 bp, Artificial Sequence
  Synthetic
cagtcatttgggatgaagtgtttggggg

SEQ ID NO: 6687 - DNA, 28 bp, Artificial Sequence
  Synthetic
cagtcatttgggttgaagtgtttggggg

SEQ ID NO: 6688 - DNA, 28 bp, Artificial Sequence
  Synthetic
cagtcatttgggatgaagtgtttggggg

SEQ ID NO: 6689 - DNA, 28 bp, Artificial Sequence
  Synthetic
cagtcatttgggatgaagtgtttggggg

SEQ ID NO: 6690 - DNA, 28 bp, Artificial Sequence
  Synthetic
cagtcatttgggatgaagtgtttggggg

SEQ ID NO: 6691 - DNA, 28 bp, Artificial Sequence
  Synthetic
cagtcatttgggatgaagtgtttggggg

SEQ ID NO: 6692 - DNA, 28 bp, Artificial Sequence
  Synthetic
cagtcatttgggatgaagtgtttggggg

SEQ ID NO: 6693 - DNA, 28 bp, Artificial Sequence
  Synthetic
cagtcatttgggatgaagtgtttggggg

SEQ ID NO: 6694 - DNA, 28 bp, Artificial Sequence
  Synthetic
cagtcatttgggatgaagtgtttggggg

SEQ ID NO: 6695 - DNA, 28 bp, Artificial Sequence
  Synthetic
cagtcatttgggatgaagtgtttggggg

SEQ ID NO: 6696 - DNA, 28 bp, Artificial Sequence
  Synthetic
cagtcatttgggttgaagcgtttggggg

SEQ ID NO: 6697 - DNA, 28 bp, Artificial Sequence
  Synthetic
cagtcatttgggtgccaaaggagatttg

SEQ ID NO: 6698 - DNA, 28 bp, Artificial Sequence
  Synthetic
cagtcatttgggtgccaaaggagagctg

SEQ ID NO: 6699 - DNA, 28 bp, Artificial Sequence
  Synthetic
cagtcatttgggtgccaaaggagatttg

SEQ ID NO: 6700 - DNA, 28 bp, Artificial Sequence
  Synthetic
cagtcatttgggtgccaaaggagagctg

SEQ ID NO: 6701 - DNA, 28 bp, Artificial Sequence
  Synthetic
cagtcatttgggtgccaaaggagatttg

SEQ ID NO: 6702 - DNA, 28 bp, Artificial Sequence
  Synthetic
cagtcatttgggatcggatccgtctgag

SEQ ID NO: 6703 - DNA, 28 bp, Artificial Sequence
  Synthetic
cagtcatttgggactccatttgttttga

SEQ ID NO: 6704 - DNA, 28 bp, Artificial Sequence
  Synthetic
cagtcatttgggtgtcttgcaggccgtc

SEQ ID NO: 6705 - DNA, 28 bp, Artificial Sequence
  Synthetic
cagtcatttgggtcttggagtaggtcat

SEQ ID NO: 6706 - DNA, 28 bp, Artificial Sequence
  Synthetic
cagtcatttgggtgacagaagagagtga

SEQ ID NO: 6707 - DNA, 28 bp, Artificial Sequence
  Synthetic
cagtcatttgggtgacagaagagagtga

SEQ ID NO: 6708 - DNA, 28 bp, Artificial Sequence
  Synthetic
cagtcatttgggtgacagaagagagtga

SEQ ID NO: 6709 - DNA, 28 bp, Artificial Sequence
  Synthetic
cagtcatttgggtgacagaagagagtga

SEQ ID NO: 6710 - DNA, 28 bp, Artificial Sequence
  Synthetic
cagtcatttgggtgacagaagagagtga

SEQ ID NO: 6711 - DNA, 28 bp, Artificial Sequence
  Synthetic
cagtcatttgggtgacagaagagagtga

SEQ ID NO: 6712 - DNA, 28 bp, Artificial Sequence
  Synthetic
cagtcatttgggtgacagaagagagtga

SEQ ID NO: 6713 - DNA, 28 bp, Artificial Sequence
  Synthetic
cagtcatttgggtgacagaagagagtga

SEQ ID NO: 6714 - DNA, 28 bp, Artificial Sequence
  Synthetic
cagtcatttgggtgacagaagagagtga

SEQ ID NO: 6715 - DNA, 28 bp, Artificial Sequence
  Synthetic
cagtcatttgggtgacagaagagagtga

SEQ ID NO: 6716 - DNA, 28 bp, Artificial Sequence
  Synthetic
cagtcatttgggtgacagaagagagaga

SEQ ID NO: 6717 - DNA, 28 bp, Artificial Sequence
  Synthetic
cagtcatttgggcgacagaagagagtga

SEQ ID NO: 6718 - DNA, 28 bp, Artificial Sequence
  Synthetic
cagtcatttgggtttggattgaagggag

SEQ ID NO: 6719 - DNA, 28 bp, Artificial Sequence
  Synthetic
cagtcatttgggtttggattgaagggag

SEQ ID NO: 6720 - DNA, 28 bp, Artificial Sequence
  Synthetic
cagtcatttgggattggattgaagggag

SEQ ID NO: 6721 - DNA, 28 bp, Artificial Sequence
  Synthetic
cagtcatttgggattggattgaagggag

SEQ ID NO: 6722 - DNA, 28 bp, Artificial Sequence
  Synthetic
cagtcatttgggattggattgaagggag

SEQ ID NO: 6723 - DNA, 28 bp, Artificial Sequence
  Synthetic
cagtcatttgggcttggattgaagggag

SEQ ID NO: 6724 - DNA, 28 bp, Artificial Sequence
  Synthetic
cagtcatttgggtgcctggctccctgta

SEQ ID NO: 6725 - DNA, 28 bp, Artificial Sequence
  Synthetic
cagtcatttgggtgcctggctccctgta

SEQ ID NO: 6726 - DNA, 28 bp, Artificial Sequence
  Synthetic
cagtcatttgggtgcctggctccctgta

SEQ ID NO: 6727 - DNA, 28 bp, Artificial Sequence
  Synthetic
cagtcatttgggtgcctggctccctgta

SEQ ID NO: 6728 - DNA, 28 bp, Artificial Sequence
  Synthetic
cagtcatttgggtgcctggctccctgta

SEQ ID NO: 6729 - DNA, 28 bp, Artificial Sequence
  Synthetic
cagtcatttgggtgcctggctccctgaa

SEQ ID NO: 6730 - DNA, 28 bp, Artificial Sequence
  Synthetic
cagtcatttgggtcgataaacctctgca

SEQ ID NO: 6731 - DNA, 28 bp, Artificial Sequence
  Synthetic
cagtcatttgggtcgataagcctctgca

SEQ ID NO: 6732 - DNA, 28 bp, Artificial Sequence
  Synthetic
cagtcatttgggtggagaagcagggcac

SEQ ID NO: 6733 - DNA, 28 bp, Artificial Sequence
  Synthetic
cagtcatttgggtggagaagcagggcac

SEQ ID NO: 6734 - DNA, 28 bp, Artificial Sequence
  Synthetic
cagtcatttgggtggagaagcagggtac

SEQ ID NO: 6735 - DNA, 28 bp, Artificial Sequence
  Synthetic
cagtcatttgggtggagaagcagggcac

SEQ ID NO: 6736 - DNA, 28 bp, Artificial Sequence
  Synthetic
cagtcatttgggtggagaagcagggcac

SEQ ID NO: 6737 - DNA, 28 bp, Artificial Sequence
  Synthetic
cagtcatttgggtggagaagcagggcac

SEQ ID NO: 6738 - DNA, 28 bp, Artificial Sequence
  Synthetic
cagtcatttgggtcggaccaggcttcat

SEQ ID NO: 6739 - DNA, 28 bp, Artificial Sequence
  Synthetic
cagtcatttgggtcggaccaggcttcat

SEQ ID NO: 6740 - DNA, 28 bp, Artificial Sequence
  Synthetic
cagtcatttgggtcggaccaggcttcat

SEQ ID NO: 6741 - DNA, 28 bp, Artificial Sequence
  Synthetic
cagtcatttgggtcggaccaggcttcat

SEQ ID NO: 6742 - DNA, 28 bp, Artificial Sequence
  Synthetic
cagtcatttgggtcgaaccaggcttcat

SEQ ID NO: 6743 - DNA, 28 bp, Artificial Sequence
  Synthetic
cagtcatttgggtcggaccaggcttcat

SEQ ID NO: 6744 - DNA, 28 bp, Artificial Sequence
  Synthetic
cagtcatttgggtcggaccaggcttcat

SEQ ID NO: 6745 - DNA, 28 bp, Artificial Sequence
  Synthetic
cagtcatttgggtcggaccaggcttcat

SEQ ID NO: 6746 - DNA, 28 bp, Artificial Sequence
  Synthetic
cagtcatttgggtcggatcaggcttcat

SEQ ID NO: 6747 - DNA, 28 bp, Artificial Sequence
  Synthetic
cagtcatttgggtcggatcaggcttcat

SEQ ID NO: 6748 - DNA, 28 bp, Artificial Sequence
  Synthetic
cagtcatttgggtcggaccaggcttcaa

SEQ ID NO: 6749 - DNA, 28 bp, Artificial Sequence
  Synthetic
cagtcatttgggtcggaccaggcttcaa

SEQ ID NO: 6750 - DNA, 28 bp, Artificial Sequence
  Synthetic
cagtcatttgggtcggaccaggcttcat

SEQ ID NO: 6751 - DNA, 28 bp, Artificial Sequence
  Synthetic
cagtcatttgggtcggaccaggcttcat

SEQ ID NO: 6752 - DNA, 28 bp, Artificial Sequence
  Synthetic
cagtcatttgggtgaagctgccagcatg

SEQ ID NO: 6753 - DNA, 28 bp, Artificial Sequence
  Synthetic
cagtcatttgggtgaagctgccagcatg

SEQ ID NO: 6754 - DNA, 28 bp, Artificial Sequence
  Synthetic
cagtcatttgggtgaagctgccagcatg

SEQ ID NO: 6755 - DNA, 28 bp, Artificial Sequence
  Synthetic
cagtcatttgggtgaagctgccagcatg

SEQ ID NO: 6756 - DNA, 28 bp, Artificial Sequence
  Synthetic
cagtcatttgggtgaagctgccagcatg

SEQ ID NO: 6757 - DNA, 28 bp, Artificial Sequence
  Synthetic
cagtcatttgggtgaagctgccagcatg

SEQ ID NO: 6758 - DNA, 28 bp, Artificial Sequence
  Synthetic
cagtcatttgggtgaagctgccagcatg

SEQ ID NO: 6759 - DNA, 28 bp, Artificial Sequence
  Synthetic
cagtcatttgggtgaagctgccagcatg

SEQ ID NO: 6760 - DNA, 28 bp, Artificial Sequence
  Synthetic
cagtcatttgggtgaagctgccagcatg

SEQ ID NO: 6761 - DNA, 28 bp, Artificial Sequence
  Synthetic
cagtcatttgggtgaagctgccagcatg

SEQ ID NO: 6762 - DNA, 28 bp, Artificial Sequence
  Synthetic
cagtcatttgggtcgcttggtgcagatc

SEQ ID NO: 6763 - DNA, 28 bp, Artificial Sequence
  Synthetic
cagtcatttgggaggcttggtgcagctc

SEQ ID NO: 6764 - DNA, 28 bp, Artificial Sequence
  Synthetic
cagtcatttgggcagccaaggatgactt

SEQ ID NO: 6765 - DNA, 28 bp, Artificial Sequence
  Synthetic
cagtcatttgggcagccaaggatgactt

SEQ ID NO: 6766 - DNA, 28 bp, Artificial Sequence
  Synthetic
cagtcatttgggcagccaaggatgactt

SEQ ID NO: 6767 - DNA, 28 bp, Artificial Sequence
  Synthetic
cagtcatttgggtagccaaggatgaatt

SEQ ID NO: 6768 - DNA, 28 bp, Artificial Sequence
  Synthetic
cagtcatttgggtagccaaggatgactt

SEQ ID NO: 6769 - DNA, 28 bp, Artificial Sequence
  Synthetic
cagtcatttgggtagccaaggatgactt

SEQ ID NO: 6770 - DNA, 28 bp, Artificial Sequence
  Synthetic
cagtcatttgggtagccaaggatgactt

SEQ ID NO: 6771 - DNA, 28 bp, Artificial Sequence
  Synthetic
cagtcatttgggtagccaaggatgactt

SEQ ID NO: 6772 - DNA, 28 bp, Artificial Sequence
  Synthetic
cagtcatttgggtagccaaggatgactt

SEQ ID NO: 6773 - DNA, 28 bp, Artificial Sequence
  Synthetic
cagtcatttgggtagccaaggatgactt

SEQ ID NO: 6774 - DNA, 28 bp, Artificial Sequence
  Synthetic
cagtcatttgggtagccaaggatgactt

SEQ ID NO: 6775 - DNA, 28 bp, Artificial Sequence
  Synthetic
cagtcatttgggtagccaaggatgactt

SEQ ID NO: 6776 - DNA, 28 bp, Artificial Sequence
  Synthetic
cagtcatttgggtagccaaggatgactt

SEQ ID NO: 6777 - DNA, 28 bp, Artificial Sequence
  Synthetic
cagtcatttgggtagccaagaatgactt

SEQ ID NO: 6778 - DNA, 28 bp, Artificial Sequence
  Synthetic
cagtcatttgggtagccaagaatgactt

SEQ ID NO: 6779 - DNA, 28 bp, Artificial Sequence
  Synthetic
cagtcatttgggtagccaaggacaaact

SEQ ID NO: 6780 - DNA, 28 bp, Artificial Sequence
  Synthetic
cagtcatttgggtagccaaggagactgc

SEQ ID NO: 6781 - DNA, 28 bp, Artificial Sequence
  Synthetic
cagtcatttgggtgattgagccgcgcca

SEQ ID NO: 6782 - DNA, 28 bp, Artificial Sequence
  Synthetic
cagtcatttgggtgattgagccgtgcca

SEQ ID NO: 6783 - DNA, 28 bp, Artificial Sequence
  Synthetic
cagtcatttgggtgattgagccgtgcca

SEQ ID NO: 6784 - DNA, 28 bp, Artificial Sequence
  Synthetic
cagtcatttgggtgattgagccgtgcca

SEQ ID NO: 6785 - DNA, 28 bp, Artificial Sequence
  Synthetic
cagtcatttgggtgattgagccgtgcca

SEQ ID NO: 6786 - DNA, 28 bp, Artificial Sequence
  Synthetic
cagtcatttgggtgattgagccgtgcca

SEQ ID NO: 6787 - DNA, 28 bp, Artificial Sequence
  Synthetic
cagtcatttggggaggtgagccgagcca

SEQ ID NO: 6788 - DNA, 28 bp, Artificial Sequence
  Synthetic
cagtcatttggggtgagccgaaccaata

SEQ ID NO: 6789 - DNA, 28 bp, Artificial Sequence
  Synthetic
cagtcatttgggggattgagccgcgtca

SEQ ID NO: 6790 - DNA, 28 bp, Artificial Sequence
  Synthetic
cagtcatttgggagaatcttgatgatgc

SEQ ID NO: 6791 - DNA, 28 bp, Artificial Sequence
  Synthetic
cagtcatttgggggaatcttgatgatgc

SEQ ID NO: 6792 - DNA, 28 bp, Artificial Sequence
  Synthetic
cagtcatttgggtgaatcttgatgatgc

SEQ ID NO: 6793 - DNA, 28 bp, Artificial Sequence
  Synthetic
cagtcatttgggagaatcttgatgatgc

SEQ ID NO: 6794 - DNA, 28 bp, Artificial Sequence
  Synthetic
cagtcatttgggttggactgaagggtgc

SEQ ID NO: 6795 - DNA, 28 bp, Artificial Sequence
  Synthetic
cagtcatttgggttggactgaagggtgc

SEQ ID NO: 6796 - DNA, 28 bp, Artificial Sequence
  Synthetic
cagtcatttgggaagctcaggagggata

SEQ ID NO: 6797 - DNA, 28 bp, Artificial Sequence
  Synthetic
cagtcatttgggtccaaagggatcgcat

SEQ ID NO: 6798 - DNA, 28 bp, Artificial Sequence
  Synthetic
cagtcatttgggtccaaagggatcgcat

SEQ ID NO: 6799 - DNA, 28 bp, Artificial Sequence
  Synthetic
cagtcatttgggttggcattctgtccac

SEQ ID NO: 6800 - DNA, 28 bp, Artificial Sequence
  Synthetic
cagtcatttggggtgaagtgcttggggg

SEQ ID NO: 6801 - DNA, 28 bp, Artificial Sequence
  Synthetic
cagtcatttggggtgaagtgtttggggg

SEQ ID NO: 6802 - DNA, 28 bp, Artificial Sequence
  Synthetic
cagtcatttggggtgaagtgtttggagg

SEQ ID NO: 6803 - DNA, 28 bp, Artificial Sequence
  Synthetic
cagtcatttggggtgaagtgtttggggg

SEQ ID NO: 6804 - DNA, 28 bp, Artificial Sequence
  Synthetic
cagtcatttggggtgaagtgtttggggg

SEQ ID NO: 6805 - DNA, 28 bp, Artificial Sequence
  Synthetic
cagtcatttggggtgaattgtttggggg

SEQ ID NO: 6806 - DNA, 28 bp, Artificial Sequence
  Synthetic
cagtcatttggggtgaagtgtttggggg

SEQ ID NO: 6807 - DNA, 28 bp, Artificial Sequence
  Synthetic
cagtcatttggggtgaagtgtttggggg

SEQ ID NO: 6808 - DNA, 28 bp, Artificial Sequence
  Synthetic
cagtcatttggggtgaagtgtttggggg

SEQ ID NO: 6809 - DNA, 28 bp, Artificial Sequence
  Synthetic
cagtcatttggggtgaagtgtttggggg

SEQ ID NO: 6810 - DNA, 28 bp, Artificial Sequence
  Synthetic
cagtcatttggggtgaagtgtttggggg

SEQ ID NO: 6811 - DNA, 28 bp, Artificial Sequence
  Synthetic
cagtcatttggggtgaagtgtttggggg

SEQ ID NO: 6812 - DNA, 28 bp, Artificial Sequence
  Synthetic
cagtcatttggggtgaagtgtttggggg

SEQ ID NO: 6813 - DNA, 28 bp, Artificial Sequence
  Synthetic
cagtcatttggggtgaagtgtttggggg

SEQ ID NO: 6814 - DNA, 28 bp, Artificial Sequence
  Synthetic
cagtcatttgggatgaagtgtttggagg

SEQ ID NO: 6815 - DNA, 28 bp, Artificial Sequence
  Synthetic
cagtcatttggggtgaagtgtttggggg

SEQ ID NO: 6816 - DNA, 28 bp, Artificial Sequence
  Synthetic
cagtcatttggggtgaagtgtttggggg

SEQ ID NO: 6817 - DNA, 28 bp, Artificial Sequence
  Synthetic
cagtcatttggggtgaagtgtttggggg

SEQ ID NO: 6818 - DNA, 28 bp, Artificial Sequence
  Synthetic
cagtcatttggggtgaagtgtttggggg

SEQ ID NO: 6819 - DNA, 28 bp, Artificial Sequence
  Synthetic
cagtcatttggggtgaagtgtttgggga

SEQ ID NO: 6820 - DNA, 28 bp, Artificial Sequence
  Synthetic
cagtcatttggggtgaagcgtttggggg

SEQ ID NO: 6821 - DNA, 28 bp, Artificial Sequence
  Synthetic
cagtcatttggggtgaagtatttggcgg

SEQ ID NO: 6822 - DNA, 28 bp, Artificial Sequence
  Synthetic
cagtcatttggggtgaagtgtttggggg

SEQ ID NO: 6823 - DNA, 28 bp, Artificial Sequence
  Synthetic
cagtcatttgggttccacagctttcttg

SEQ ID NO: 6824 - DNA, 28 bp, Artificial Sequence
  Synthetic
cagtcatttgggttccacagctttcttg

SEQ ID NO: 6825 - DNA, 28 bp, Artificial Sequence
  Synthetic
cagtcatttgggttccacagctttcttg

SEQ ID NO: 6826 - DNA, 28 bp, Artificial Sequence
  Synthetic
cagtcatttgggtccacaggctttcttg

SEQ ID NO: 6827 - DNA, 28 bp, Artificial Sequence
  Synthetic
cagtcatttgggtccacaggctttcttg

SEQ ID NO: 6828 - DNA, 28 bp, Artificial Sequence
  Synthetic
cagtcatttgggtcattgagtgcagcgt

SEQ ID NO: 6829 - DNA, 28 bp, Artificial Sequence
  Synthetic
cagtcatttgggttattgagtgcagcgt

SEQ ID NO: 6830 - DNA, 28 bp, Artificial Sequence
  Synthetic
cagtcatttgggtgtgttctcaggtcac

SEQ ID NO: 6831 - DNA, 28 bp, Artificial Sequence
  Synthetic
cagtcatttgggtgtgttctcaggtcgc

SEQ ID NO: 6832 - DNA, 28 bp, Artificial Sequence
  Synthetic
cagtcatttgggtgccaaaggagaattg

SEQ ID NO: 6833 - DNA, 28 bp, Artificial Sequence
  Synthetic
cagtcatttgggtgccaaaggagaattg

SEQ ID NO: 6834 - DNA, 28 bp, Artificial Sequence
  Synthetic
cagtcatttgggtgccaaaggagaattg

SEQ ID NO: 6835 - DNA, 28 bp, Artificial Sequence
  Synthetic
cagtcatttgggtgccaaaggagagttg

SEQ ID NO: 6836 - DNA, 28 bp, Artificial Sequence
  Synthetic
cagtcatttgggtgccaaaggagatttg

SEQ ID NO: 6837 - DNA, 28 bp, Artificial Sequence
  Synthetic
cagtcatttgggtgccaaaggagatttg

SEQ ID NO: 6838 - DNA, 28 bp, Artificial Sequence
  Synthetic
cagtcatttgggtgccaaaggagatttg

SEQ ID NO: 6839 - DNA, 28 bp, Artificial Sequence
  Synthetic
cagtcatttgggtgccaaaggagacttg

SEQ ID NO: 6840 - DNA, 28 bp, Artificial Sequence
  Synthetic
cagtcatttgggtgccaaaggagagctg

SEQ ID NO: 6841 - DNA, 28 bp, Artificial Sequence
  Synthetic
cagtcatttgggtgccaaaggagagttg

SEQ ID NO: 6842 - DNA, 28 bp, Artificial Sequence
  Synthetic
cagtcatttgggtgccaaaggaaatttg

SEQ ID NO: 6843 - DNA, 28 bp, Artificial Sequence
  Synthetic
cagtcatttgggctgcactgcctcttcc

SEQ ID NO: 6844 - DNA, 28 bp, Artificial Sequence
  Synthetic
cagtcatttgggctagtttcacttgttc

SEQ ID NO: 6845 - DNA, 28 bp, Artificial Sequence
  Synthetic
cagtcatttgggtcatcctcatcatcat

SEQ ID NO: 6846 - DNA, 28 bp, Artificial Sequence
  Synthetic
cagtcatttgggaacagaacagaagcag

SEQ ID NO: 6847 - DNA, 28 bp, Artificial Sequence
  Synthetic
cagtcatttgggtgttcgtccgtacact

SEQ ID NO: 6848 - DNA, 28 bp, Artificial Sequence
  Synthetic
cagtcatttggggaatgtagtgaatttg

SEQ ID NO: 6849 - DNA, 28 bp, Artificial Sequence
  Synthetic
cagtcatttgggtaatgtgatgatgaaa

SEQ ID NO: 6850 - DNA, 28 bp, Artificial Sequence
  Synthetic
cagtcatttgggtgatgaatgctgacga

SEQ ID NO: 6851 - DNA, 28 bp, Artificial Sequence
  Synthetic
cagtcatttgggtaaattaatcacggaa

SEQ ID NO: 6852 - DNA, 28 bp, Artificial Sequence
  Synthetic
cagtcatttgggttttggaagtttgtcc

SEQ ID NO: 6853 - DNA, 28 bp, Artificial Sequence
  Synthetic
cagtcatttgggttatccggtattggag

SEQ ID NO: 6854 - DNA, 28 bp, Artificial Sequence
  Synthetic
cagtcatttgggaaagttagagaagttt

SEQ ID NO: 6855 - DNA, 28 bp, Artificial Sequence
  Synthetic
cagtcatttgggttcccacgcgttatag

SEQ ID NO: 6856 - DNA, 28 bp, Artificial Sequence
  Synthetic
cagtcatttgggtgtcgaaccgcggttg

SEQ ID NO: 6857 - DNA, 28 bp, Artificial Sequence
  Synthetic
cagtcatttgggtgtcgaaccgcggttg

SEQ ID NO: 6858 - DNA, 28 bp, Artificial Sequence
  Synthetic
cagtcatttgggtgtcgaaccgcggttg

SEQ ID NO: 6859 - DNA, 28 bp, Artificial Sequence
  Synthetic
cagtcatttgggtgtcgaaccgcggttg

SEQ ID NO: 6860 - DNA, 28 bp, Artificial Sequence
  Synthetic
cagtcatttgggtgtcgaaccgcggttg

SEQ ID NO: 6861 - DNA, 28 bp, Artificial Sequence
  Synthetic
cagtcatttgggtgtcgaaccgcggttg

SEQ ID NO: 6862 - DNA, 28 bp, Artificial Sequence
  Synthetic
cagtcatttgggtgtcgaaccgcggttg

SEQ ID NO: 6863 - DNA, 28 bp, Artificial Sequence
  Synthetic
cagtcatttgggtgtcgaaccgcggttg

SEQ ID NO: 6864 - DNA, 28 bp, Artificial Sequence
  Synthetic
cagtcatttgggtgtcgaaccgcggttg

SEQ ID NO: 6865 - DNA, 28 bp, Artificial Sequence
  Synthetic
cagtcatttgggtgtcgaaccgcggttg

SEQ ID NO: 6866 - DNA, 28 bp, Artificial Sequence
  Synthetic
cagtcatttgggagtgtctcctgatgat

SEQ ID NO: 6867 - DNA, 28 bp, Artificial Sequence
  Synthetic
cagtcatttgggtaccatcaatataaat

SEQ ID NO: 6868 - DNA, 28 bp, Artificial Sequence
  Synthetic
cagtcatttgggtaccatcaatataaat

SEQ ID NO: 6869 - DNA, 28 bp, Artificial Sequence
  Synthetic
cagtcatttgggtaccatcaatataaat

SEQ ID NO: 6870 - DNA, 28 bp, Artificial Sequence
  Synthetic
cagtcatttgggtgacgtgtaaattgcg

SEQ ID NO: 6871 - DNA, 28 bp, Artificial Sequence
  Synthetic
cagtcatttgggatcacaatacaataaa

SEQ ID NO: 6872 - DNA, 28 bp, Artificial Sequence
  Synthetic
cagtcatttgggttgctgcctcaagctt

SEQ ID NO: 6873 - DNA, 28 bp, Artificial Sequence
  Synthetic
cagtcatttgggtaaattagtgtataaa

SEQ ID NO: 6874 - DNA, 28 bp, Artificial Sequence
  Synthetic
cagtcatttgggtaaattagtgtataaa

SEQ ID NO: 6875 - DNA, 28 bp, Artificial Sequence
  Synthetic
cagtcatttgggtaaattagtgtataaa

SEQ ID NO: 6876 - DNA, 28 bp, Artificial Sequence
  Synthetic
cagtcatttgggtaaattagtgtataaa

SEQ ID NO: 6877 - DNA, 28 bp, Artificial Sequence
  Synthetic
cagtcatttgggtaaattagtgtataaa

SEQ ID NO: 6878 - DNA, 28 bp, Artificial Sequence
  Synthetic
cagtcatttgggtaaattagtgtataaa

SEQ ID NO: 6879 - DNA, 28 bp, Artificial Sequence
  Synthetic
cagtcatttgggtaaattagtgtataaa

SEQ ID NO: 6880 - DNA, 28 bp, Artificial Sequence
  Synthetic
cagtcatttgggtaaattagtgtataaa

SEQ ID NO: 6881 - DNA, 28 bp, Artificial Sequence
  Synthetic
cagtcatttgggtaaattagtgtataaa

SEQ ID NO: 6882 - DNA, 28 bp, Artificial Sequence
  Synthetic
cagtcatttgggcatcaatatgaatatg

SEQ ID NO: 6883 - DNA, 28 bp, Artificial Sequence
  Synthetic
cagtcatttgggtggaaggggcatgcag

SEQ ID NO: 6884 - DNA, 28 bp, Artificial Sequence
  Synthetic
cagtcatttgggctgtaccctctctctt

SEQ ID NO: 6885 - DNA, 28 bp, Artificial Sequence
  Synthetic
cagtcatttgggaggtgcagaggcagat

SEQ ID NO: 6886 - DNA, 28 bp, Artificial Sequence
  Synthetic
cagtcatttgggctcgccggggctgcgt

SEQ ID NO: 6887 - DNA, 28 bp, Artificial Sequence
  Synthetic
cagtcatttgggtgacaacgagagagag

SEQ ID NO: 6888 - DNA, 28 bp, Artificial Sequence
  Synthetic
cagtcatttgggatgtgctaaaaagtca

SEQ ID NO: 6889 - DNA, 28 bp, Artificial Sequence
  Synthetic
cagtcatttgggatgtgctaaaaagtca

SEQ ID NO: 6890 - DNA, 28 bp, Artificial Sequence
  Synthetic
cagtcatttgggatgtgctaaaaagtca

SEQ ID NO: 6891 - DNA, 28 bp, Artificial Sequence
  Synthetic
cagtcatttgggatgtgctaaaaagtca

SEQ ID NO: 6892 - DNA, 28 bp, Artificial Sequence
  Synthetic
cagtcatttgggatgtgctaaaaagtca

SEQ ID NO: 6893 - DNA, 28 bp, Artificial Sequence
  Synthetic
cagtcatttgggatgtgctaaaaagtca

SEQ ID NO: 6894 - DNA, 28 bp, Artificial Sequence
  Synthetic
cagtcatttgggatgtgctaaaaagtca

SEQ ID NO: 6895 - DNA, 28 bp, Artificial Sequence
  Synthetic
cagtcatttgggatgtgctaaaaagtca

SEQ ID NO: 6896 - DNA, 28 bp, Artificial Sequence
  Synthetic
cagtcatttgggcgtcatctcacaggtg

SEQ ID NO: 6897 - DNA, 28 bp, Artificial Sequence
  Synthetic
cagtcatttgggcgtcatctcacaggtg

SEQ ID NO: 6898 - DNA, 28 bp, Artificial Sequence
  Synthetic
cagtcatttgggcgtcatctcacaggtg

SEQ ID NO: 6899 - DNA, 28 bp, Artificial Sequence
  Synthetic
cagtcatttgggatgaatgtgggaaatg

SEQ ID NO: 6900 - DNA, 28 bp, Artificial Sequence
  Synthetic
cagtcatttgggtgaatgtgagaaatgt

SEQ ID NO: 6901 - DNA, 28 bp, Artificial Sequence
  Synthetic
cagtcatttgggtgaatgtgagaaatgt

SEQ ID NO: 6902 - DNA, 28 bp, Artificial Sequence
  Synthetic
cagtcatttgggtgaatgtgagaaatgt

SEQ ID NO: 6903 - DNA, 28 bp, Artificial Sequence
  Synthetic
cagtcatttgggtgaatgtgagaaatgt

SEQ ID NO: 6904 - DNA, 28 bp, Artificial Sequence
  Synthetic
cagtcatttgggtgaatgtgagaaatgt

SEQ ID NO: 6905 - DNA, 28 bp, Artificial Sequence
  Synthetic
cagtcatttgggtgaatgtgagaaatgt

SEQ ID NO: 6906 - DNA, 28 bp, Artificial Sequence
  Synthetic
cagtcatttgggtgaatgtgagaaatgt

SEQ ID NO: 6907 - DNA, 28 bp, Artificial Sequence
  Synthetic
cagtcatttgggtgaatgtgagaaatgt

SEQ ID NO: 6908 - DNA, 28 bp, Artificial Sequence
  Synthetic
cagtcatttgggtcataagcccaccaca

SEQ ID NO: 6909 - DNA, 28 bp, Artificial Sequence
  Synthetic
cagtcatttgggaccgttagatcgagaa

SEQ ID NO: 6910 - DNA, 28 bp, Artificial Sequence
  Synthetic
cagtcatttgggaccgttagatcgagaa

SEQ ID NO: 6911 - DNA, 28 bp, Artificial Sequence
  Synthetic
cagtcatttgggaccgttagatcgagaa

SEQ ID NO: 6912 - DNA, 28 bp, Artificial Sequence
  Synthetic
cagtcatttggggacggacggttaaacg

SEQ ID NO: 6913 - DNA, 28 bp, Artificial Sequence
  Synthetic
cagtcatttggggacggacggttaaacg

SEQ ID NO: 6914 - DNA, 28 bp, Artificial Sequence
  Synthetic
cagtcatttggggacggacggttaaacg

SEQ ID NO: 6915 - DNA, 28 bp, Artificial Sequence
  Synthetic
cagtcatttggggacggacggttaaacg

SEQ ID NO: 6916 - DNA, 28 bp, Artificial Sequence
  Synthetic
cagtcatttggggacggacggttaaacg

SEQ ID NO: 6917 - DNA, 28 bp, Artificial Sequence
  Synthetic
cagtcatttggggggttatggaatgggt

SEQ ID NO: 6918 - DNA, 28 bp, Artificial Sequence
  Synthetic
cagtcatttgggcacttcatagtacaac

SEQ ID NO: 6919 - DNA, 28 bp, Artificial Sequence
  Synthetic
cagtcatttgggcacttcatagtacaac

SEQ ID NO: 6920 - DNA, 28 bp, Artificial Sequence
  Synthetic
cagtcatttgggcacttcatagtacaac

SEQ ID NO: 6921 - DNA, 28 bp, Artificial Sequence
  Synthetic
cagtcatttgggaaggggattgaggaga

SEQ ID NO: 6922 - DNA, 28 bp, Artificial Sequence
  Synthetic
cagtcatttgggaaggggattgaggaga

SEQ ID NO: 6923 - DNA, 28 bp, Artificial Sequence
  Synthetic
cagtcatttgggaaggggattgaggaga

SEQ ID NO: 6924 - DNA, 28 bp, Artificial Sequence
  Synthetic
cagtcatttggggtgacatattttacta

SEQ ID NO: 6925 - DNA, 28 bp, Artificial Sequence
  Synthetic
cagtcatttgggtccaacttgaggcccg

SEQ ID NO: 6926 - DNA, 28 bp, Artificial Sequence
  Synthetic
cagtcatttgggaatcccttatattatg

SEQ ID NO: 6927 - DNA, 28 bp, Artificial Sequence
  Synthetic
cagtcatttgggaatcccttatattatg

SEQ ID NO: 6928 - DNA, 28 bp, Artificial Sequence
  Synthetic
cagtcatttgggaatcccttatattatg

SEQ ID NO: 6929 - DNA, 28 bp, Artificial Sequence
  Synthetic
cagtcatttgggaatcccttatattatg

SEQ ID NO: 6930 - DNA, 28 bp, Artificial Sequence
  Synthetic
cagtcatttgggaatcccttatattatg

SEQ ID NO: 6931 - DNA, 28 bp, Artificial Sequence
  Synthetic
cagtcatttgggtcaggttataagactt

SEQ ID NO: 6932 - DNA, 28 bp, Artificial Sequence
  Synthetic
cagtcatttgggtcaggttataagactt

SEQ ID NO: 6933 - DNA, 28 bp, Artificial Sequence
  Synthetic
cagtcatttgggtcaggttataagactt

SEQ ID NO: 6934 - DNA, 28 bp, Artificial Sequence
  Synthetic
cagtcatttgggtcaggttataagactt

SEQ ID NO: 6935 - DNA, 28 bp, Artificial Sequence
  Synthetic
cagtcatttgggtcaggttataagactt

SEQ ID NO: 6936 - DNA, 28 bp, Artificial Sequence
  Synthetic
cagtcatttgggtcaggttataagactt

SEQ ID NO: 6937 - DNA, 28 bp, Artificial Sequence
  Synthetic
cagtcatttgggtcaggttataagactt

SEQ ID NO: 6938 - DNA, 28 bp, Artificial Sequence
  Synthetic
cagtcatttgggtcaggttataagactt

SEQ ID NO: 6939 - DNA, 28 bp, Artificial Sequence
  Synthetic
cagtcatttgggtcaggttataagactt

SEQ ID NO: 6940 - DNA, 28 bp, Artificial Sequence
  Synthetic
cagtcatttgggtcaggttataagactt

SEQ ID NO: 6941 - DNA, 28 bp, Artificial Sequence
  Synthetic
cagtcatttgggtcaggttataagactt

SEQ ID NO: 6942 - DNA, 28 bp, Artificial Sequence
  Synthetic
cagtcatttgggcggcctcgtggatgga

SEQ ID NO: 6943 - DNA, 28 bp, Artificial Sequence
  Synthetic
cagtcatttgggcggcctcgtggatgga

SEQ ID NO: 6944 - DNA, 28 bp, Artificial Sequence
  Synthetic
cagtcatttgggcggcctcgtggatgga

SEQ ID NO: 6945 - DNA, 28 bp, Artificial Sequence
  Synthetic
cagtcatttgggaagtcatcaacaaaaa

SEQ ID NO: 6946 - DNA, 28 bp, Artificial Sequence
  Synthetic
cagtcatttgggaagtcatcaacaaaaa

SEQ ID NO: 6947 - DNA, 28 bp, Artificial Sequence
  Synthetic
cagtcatttgggaagtcatcaacaaaaa

SEQ ID NO: 6948 - DNA, 28 bp, Artificial Sequence
  Synthetic
cagtcatttgggtggaatgtaaagaagt

SEQ ID NO: 6949 - DNA, 28 bp, Artificial Sequence
  Synthetic
cagtcatttgggaacccgtagatccgaa

SEQ ID NO: 6950 - DNA, 28 bp, Artificial Sequence
  Synthetic
cagtcatttgggtacagtactgtgataa

SEQ ID NO: 6951 - DNA, 28 bp, Artificial Sequence
  Synthetic
cagtcatttgggagcagcattgtacagg

SEQ ID NO: 6952 - DNA, 28 bp, Artificial Sequence
  Synthetic
cagtcatttgggtcaaatgctcagactc

SEQ ID NO: 6953 - DNA, 28 bp, Artificial Sequence
  Synthetic
cagtcatttgggaaaagtgcttacagtg

SEQ ID NO: 6954 - DNA, 28 bp, Artificial Sequence
  Synthetic
cagtcatttgggtaaagtgctgacagtg

SEQ ID NO: 6955 - DNA, 28 bp, Artificial Sequence
  Synthetic
cagtcatttgggagcagcattgtacagg

SEQ ID NO: 6956 - DNA, 28 bp, Artificial Sequence
  Synthetic
cagtcatttgggtaccctgtagatccga

SEQ ID NO: 6957 - DNA, 28 bp, Artificial Sequence
  Synthetic
cagtcatttgggtaccctgtagaaccga

SEQ ID NO: 6958 - DNA, 28 bp, Artificial Sequence
  Synthetic
cagtcatttgggttaaggcacgcggtga

SEQ ID NO: 6959 - DNA, 28 bp, Artificial Sequence
  Synthetic
cagtcatttgggtccctgagaccctaac

SEQ ID NO: 6960 - DNA, 28 bp, Artificial Sequence
  Synthetic
cagtcatttgggtcacagtgaaccggtc

SEQ ID NO: 6961 - DNA, 28 bp, Artificial Sequence
  Synthetic
cagtcatttgggcagtgcaatgttaaaa

SEQ ID NO: 6962 - DNA, 28 bp, Artificial Sequence
  Synthetic
cagtcatttgggttggtccccttcaacc

SEQ ID NO: 6963 - DNA, 28 bp, Artificial Sequence
  Synthetic
cagtcatttgggtgtgactggttgacca

SEQ ID NO: 6964 - DNA, 28 bp, Artificial Sequence
  Synthetic
cagtcatttgggtatggctttttattcc

SEQ ID NO: 6965 - DNA, 28 bp, Artificial Sequence
  Synthetic
cagtcatttgggactccatttgttttga

SEQ ID NO: 6966 - DNA, 28 bp, Artificial Sequence
  Synthetic
cagtcatttgggtctacagtgcacgtgt

SEQ ID NO: 6967 - DNA, 28 bp, Artificial Sequence
  Synthetic
cagtcatttgggaacactgtctggtaaa

SEQ ID NO: 6968 - DNA, 28 bp, Artificial Sequence
  Synthetic
cagtcatttgggtgagatgaagcactgt

SEQ ID NO: 6969 - DNA, 28 bp, Artificial Sequence
  Synthetic
cagtcatttgggtacagtatagatgatg

SEQ ID NO: 6970 - DNA, 28 bp, Artificial Sequence
  Synthetic
cagtcatttggggtgtgtggaaatgctt

SEQ ID NO: 6971 - DNA, 28 bp, Artificial Sequence
  Synthetic
cagtcatttgggtaggttatccgtgttg

SEQ ID NO: 6972 - DNA, 28 bp, Artificial Sequence
  Synthetic
cagtcatttgggtagcagcacataatgg

SEQ ID NO: 6973 - DNA, 28 bp, Artificial Sequence
  Synthetic
cagtcatttgggtagcagcacatcatgg

SEQ ID NO: 6974 - DNA, 28 bp, Artificial Sequence
  Synthetic
cagtcatttgggtagcagcacgtaaata

SEQ ID NO: 6975 - DNA, 28 bp, Artificial Sequence
  Synthetic
cagtcatttgggactgcagtgaaggcac

SEQ ID NO: 6976 - DNA, 28 bp, Artificial Sequence
  Synthetic
cagtcatttgggcaaagtgcttacagtg

SEQ ID NO: 6977 - DNA, 28 bp, Artificial Sequence
  Synthetic
cagtcatttgggtaaggtgcatctagtg

SEQ ID NO: 6978 - DNA, 28 bp, Artificial Sequence
  Synthetic
cagtcatttgggaacattcaacgctgtc

SEQ ID NO: 6979 - DNA, 28 bp, Artificial Sequence
  Synthetic
cagtcatttgggaccatcgaccgttgat

SEQ ID NO: 6980 - DNA, 28 bp, Artificial Sequence
  Synthetic
cagtcatttgggaacattcattgctgtc

SEQ ID NO: 6981 - DNA, 28 bp, Artificial Sequence
  Synthetic
cagtcatttgggaacattcaacctgtcg

SEQ ID NO: 6982 - DNA, 28 bp, Artificial Sequence
  Synthetic
cagtcatttgggtatggcactggtagaa

SEQ ID NO: 6983 - DNA, 28 bp, Artificial Sequence
  Synthetic
cagtcatttgggcaaagaattctccttt

SEQ ID NO: 6984 - DNA, 28 bp, Artificial Sequence
  Synthetic
cagtcatttgggtcgtgtcttgtgttgc

SEQ ID NO: 6985 - DNA, 28 bp, Artificial Sequence
  Synthetic
cagtcatttgggcatcccttgcatggtg

SEQ ID NO: 6986 - DNA, 28 bp, Artificial Sequence
  Synthetic
cagtcatttggggtgcctactgagctga

SEQ ID NO: 6987 - DNA, 28 bp, Artificial Sequence
  Synthetic
cagtcatttgggtgatatgtttgatata

SEQ ID NO: 6988 - DNA, 28 bp, Artificial Sequence
  Synthetic
cagtcatttgggtagcagcacagaaata

SEQ ID NO: 6989 - DNA, 28 bp, Artificial Sequence
  Synthetic
cagtcatttgggtaggtagtttcatgtt

SEQ ID NO: 6990 - DNA, 28 bp, Artificial Sequence
  Synthetic
cagtcatttgggttcaccaccttctcca

SEQ ID NO: 6991 - DNA, 28 bp, Artificial Sequence
  Synthetic
cagtcatttgggggtccagaggggagat

SEQ ID NO: 6992 - DNA, 28 bp, Artificial Sequence
  Synthetic
cagtcatttgggcccagtgttcagacta

SEQ ID NO: 6993 - DNA, 28 bp, Artificial Sequence
  Synthetic
cagtcatttgggtgtgcaaatctatgca

SEQ ID NO: 6994 - DNA, 28 bp, Artificial Sequence
  Synthetic
cagtcatttgggtgtgcaaatccatgca

SEQ ID NO: 6995 - DNA, 28 bp, Artificial Sequence
  Synthetic
cagtcatttgggtaaagtgcttatagtg

SEQ ID NO: 6996 - DNA, 28 bp, Artificial Sequence
  Synthetic
cagtcatttgggttccctttgtcatcct

SEQ ID NO: 6997 - DNA, 28 bp, Artificial Sequence
  Synthetic
cagtcatttgggtccttcattccaccgg

SEQ ID NO: 6998 - DNA, 28 bp, Artificial Sequence
  Synthetic
cagtcatttgggtagcttatcagactga

SEQ ID NO: 6999 - DNA, 28 bp, Artificial Sequence
  Synthetic
cagtcatttgggacagcaggcacagaca

SEQ ID NO: 7000 - DNA, 28 bp, Artificial Sequence
  Synthetic
cagtcatttgggtaatctcagctggcaa

SEQ ID NO: 7001 - DNA, 28 bp, Artificial Sequence
  Synthetic
cagtcatttgggtactgcatcaggaact

SEQ ID NO: 7002 - DNA, 28 bp, Artificial Sequence
  Synthetic
cagtcatttgggttgtgcttgatctaac

SEQ ID NO: 7003 - DNA, 28 bp, Artificial Sequence
  Synthetic
cagtcatttgggaagctgccagttgaag

SEQ ID NO: 7004 - DNA, 28 bp, Artificial Sequence
  Synthetic
cagtcatttgggccacaccgtatctgac

SEQ ID NO: 7005 - DNA, 28 bp, Artificial Sequence
  Synthetic
cagtcatttgggagctacattgtctgct

SEQ ID NO: 7006 - DNA, 28 bp, Artificial Sequence
  Synthetic
cagtcatttgggtgtcagtttgtcaaat

SEQ ID NO: 7007 - DNA, 28 bp, Artificial Sequence
  Synthetic
cagtcatttgggcaagtcactagtggtt

SEQ ID NO: 7008 - DNA, 28 bp, Artificial Sequence
  Synthetic
cagtcatttgggatcacattgccaggga

SEQ ID NO: 7009 - DNA, 28 bp, Artificial Sequence
  Synthetic
cagtcatttgggatcacattgccaggga

SEQ ID NO: 7010 - DNA, 28 bp, Artificial Sequence
  Synthetic
cagtcatttgggtggctcagttcagcag

SEQ ID NO: 7011 - DNA, 28 bp, Artificial Sequence
  Synthetic
cagtcatttgggcattgcacttgtctcg

SEQ ID NO: 7012 - DNA, 28 bp, Artificial Sequence
  Synthetic
cagtcatttgggttcaagtaatccagga

SEQ ID NO: 7013 - DNA, 28 bp, Artificial Sequence
  Synthetic
cagtcatttgggttcacagtggctaagt

SEQ ID NO: 7014 - DNA, 28 bp, Artificial Sequence
  Synthetic
cagtcatttgggaaggagctcacagtct

SEQ ID NO: 7015 - DNA, 28 bp, Artificial Sequence
  Synthetic
cagtcatttgggctagcaccatctgaaa

SEQ ID NO: 7016 - DNA, 28 bp, Artificial Sequence
  Synthetic
cagtcatttgggtagcaccatttgaaat

SEQ ID NO: 7017 - DNA, 28 bp, Artificial Sequence
  Synthetic
cagtcatttgggctttcagtcggatgtt

SEQ ID NO: 7018 - DNA, 28 bp, Artificial Sequence
  Synthetic
cagtcatttgggtgtaaacatcctcgac

SEQ ID NO: 7019 - DNA, 28 bp, Artificial Sequence
  Synthetic
cagtcatttgggtgtaaacatcctacac

SEQ ID NO: 7020 - DNA, 28 bp, Artificial Sequence
  Synthetic
cagtcatttgggtgtaaacatccccgac

SEQ ID NO: 7021 - DNA, 28 bp, Artificial Sequence
  Synthetic
cagtcatttgggggcaagatgctggcat

SEQ ID NO: 7022 - DNA, 28 bp, Artificial Sequence
  Synthetic
cagtcatttgggtattgcacattactaa

SEQ ID NO: 7023 - DNA, 28 bp, Artificial Sequence
  Synthetic
cagtcatttggggtgcattgtagttgca

SEQ ID NO: 7024 - DNA, 28 bp, Artificial Sequence
  Synthetic
cagtcatttgggtggcagtgtcttagct

SEQ ID NO: 7025 - DNA, 28 bp, Artificial Sequence
  Synthetic
cagtcatttgggtggaagactagtgatt

SEQ ID NO: 7026 - DNA, 28 bp, Artificial Sequence
  Synthetic
cagtcatttgggtattgcacttgtcccg

SEQ ID NO: 7027 - DNA, 28 bp, Artificial Sequence
  Synthetic
cagtcatttgggaaagtgctgttcgtgc

SEQ ID NO: 7028 - DNA, 28 bp, Artificial Sequence
  Synthetic
cagtcatttgggttcaacgggtatttat

SEQ ID NO: 7029 - DNA, 28 bp, Artificial Sequence
  Synthetic
cagtcatttgggtttggcactagcacat

SEQ ID NO: 7030 - DNA, 28 bp, Artificial Sequence
  Synthetic
cagtcatttgggtgaggtagtaagttgt

SEQ ID NO: 7031 - DNA, 28 bp, Artificial Sequence
  Synthetic
cagtcatttgggaacccgtagatccgat

SEQ ID NO: 7032 - DNA, 28 bp, Artificial Sequence
  Synthetic
cagtcatttgggagaagcctttgtggga

SEQ ID NO: 7033 - DNA, 28 bp, Artificial Sequence
  Synthetic
cagtcatttgggagggagggatggttat

SEQ ID NO: 7034 - DNA, 28 bp, Artificial Sequence
  Synthetic
cagtcatttgggcgtgggacagcataga

SEQ ID NO: 7035 - DNA, 28 bp, Artificial Sequence
  Synthetic
cagtcatttggggttggaagccttcgtg

SEQ ID NO: 7036 - DNA, 28 bp, Artificial Sequence
  Synthetic
cagtcatttgggtactatgagaatctcg

SEQ ID NO: 7037 - DNA, 28 bp, Artificial Sequence
  Synthetic
cagtcatttgggtcattgcaaaactgta

SEQ ID NO: 7038 - DNA, 28 bp, Artificial Sequence
  Synthetic
cagtcatttgggtgatggtgatgcgctt

SEQ ID NO: 7039 - DNA, 28 bp, Artificial Sequence
  Synthetic
cagtcatttgggaatttgaagcatgatg

SEQ ID NO: 7040 - DNA, 28 bp, Artificial Sequence
  Synthetic
cagtcatttgggccttagagtcgtaggc

SEQ ID NO: 7041 - DNA, 28 bp, Artificial Sequence
  Synthetic
cagtcatttgggcttcctgcctctcact

SEQ ID NO: 7042 - DNA, 28 bp, Artificial Sequence
  Synthetic
cagtcatttgggcttcctgcctctcact

SEQ ID NO: 7043 - DNA, 28 bp, Artificial Sequence
  Synthetic
cagtcatttgggcttcctgcctctcact

SEQ ID NO: 7044 - DNA, 28 bp, Artificial Sequence
  Synthetic
cagtcatttgggttcctgcctctcacta

SEQ ID NO: 7045 - DNA, 28 bp, Artificial Sequence
  Synthetic
cagtcatttggggaagatagaggagttc

SEQ ID NO: 7046 - DNA, 28 bp, Artificial Sequence
  Synthetic
cagtcatttggggaagatagaggagttc

SEQ ID NO: 7047 - DNA, 28 bp, Artificial Sequence
  Synthetic
cagtcatttgggtggatggtgtgcaggg

SEQ ID NO: 7048 - DNA, 28 bp, Artificial Sequence
  Synthetic
cagtcatttgggttgaaggagttcattg

SEQ ID NO: 7049 - DNA, 28 bp, Artificial Sequence
  Synthetic
cagtcatttgggttgtagagtcatacac

SEQ ID NO: 7050 - DNA, 28 bp, Artificial Sequence
  Synthetic
cagtcatttgggtgacagaagagagtga

SEQ ID NO: 7051 - DNA, 28 bp, Artificial Sequence
  Synthetic
cagtcatttgggcttggactgaagggag

SEQ ID NO: 7052 - DNA, 28 bp, Artificial Sequence
  Synthetic
cagtcatttgggcttggactgaagggag

SEQ ID NO: 7053 - DNA, 28 bp, Artificial Sequence
  Synthetic
cagtcatttgggcttggactgaagggag

SEQ ID NO: 7054 - DNA, 28 bp, Artificial Sequence
  Synthetic
cagtcatttgggcttggactgaagggag

SEQ ID NO: 7055 - DNA, 28 bp, Artificial Sequence
  Synthetic
cagtcatttgggaagctcaggagggata

SEQ ID NO: 7056 - DNA, 28 bp, Artificial Sequence
  Synthetic
cagtcatttgggaagctcaggagggata

SEQ ID NO: 7057 - DNA, 28 bp, Artificial Sequence
  Synthetic
cagtcatttgggagctcaggagggatag

SEQ ID NO: 7058 - DNA, 28 bp, Artificial Sequence
  Synthetic
cagtcatttggggagctggccaggctgt

SEQ ID NO: 7059 - DNA, 28 bp, Artificial Sequence
  Synthetic
cagtcatttggggagctgtccaggctgt

SEQ ID NO: 7060 - DNA, 28 bp, Artificial Sequence
  Synthetic
cagtcatttgggtatgtccattgcagtt

SEQ ID NO: 7061 - DNA, 28 bp, Artificial Sequence
  Synthetic
cagtcatttgggtgacaacgagagagag

SEQ ID NO: 7062 - DNA, 28 bp, Artificial Sequence
  Synthetic
cagtcatttgggtgacaacgagagagag

SEQ ID NO: 7063 - DNA, 28 bp, Artificial Sequence
  Synthetic
cagtcatttgggtgacaacgagagagag

SEQ ID NO: 7064 - DNA, 28 bp, Artificial Sequence
  Synthetic
cagtcatttgggtgacaacgagagagag

SEQ ID NO: 7065 - DNA, 28 bp, Artificial Sequence
  Synthetic
cagtcatttgggttcgtgccaagctgtg

SEQ ID NO: 7066 - DNA, 28 bp, Artificial Sequence
  Synthetic
cagtcatttgggttgaggtgtttctaca

SEQ ID NO: 7067 - DNA, 28 bp, Artificial Sequence
  Synthetic
cagtcatttgggttgaggtgtttctaca

SEQ ID NO: 7068 - DNA, 28 bp, Artificial Sequence
  Synthetic
cagtcatttgggttgcatggagtctatg

SEQ ID NO: 7069 - DNA, 28 bp, Artificial Sequence
  Synthetic
cagtcatttgggttgcatggagtctatg

SEQ ID NO: 7070 - DNA, 28 bp, Artificial Sequence
  Synthetic
cagtcatttgggttgcatggagtctatg

SEQ ID NO: 7071 - DNA, 28 bp, Artificial Sequence
  Synthetic
cagtcatttgggaacccgtagatccgaa

SEQ ID NO: 7072 - DNA, 28 bp, Artificial Sequence
  Synthetic
cagtcatttgggtacagtactgtgataa

SEQ ID NO: 7073 - DNA, 28 bp, Artificial Sequence
  Synthetic
cagtcatttgggagcagcattgtacagg

SEQ ID NO: 7074 - DNA, 28 bp, Artificial Sequence
  Synthetic
cagtcatttgggtcaaatgctcagactc

SEQ ID NO: 7075 - DNA, 28 bp, Artificial Sequence
  Synthetic
cagtcatttgggaaaagtgcttacagtg

SEQ ID NO: 7076 - DNA, 28 bp, Artificial Sequence
  Synthetic
cagtcatttgggtaaagtgctgacagtg

SEQ ID NO: 7077 - DNA, 28 bp, Artificial Sequence
  Synthetic
cagtcatttgggagcagcattgtacagg

SEQ ID NO: 7078 - DNA, 28 bp, Artificial Sequence
  Synthetic
cagtcatttgggtaccccgtagatccga

SEQ ID NO: 7079 - DNA, 28 bp, Artificial Sequence
  Synthetic
cagtcatttgggttaaggcacgcggtga

SEQ ID NO: 7080 - DNA, 28 bp, Artificial Sequence
  Synthetic
cagtcatttgggtccctgagaccctaac

SEQ ID NO: 7081 - DNA, 28 bp, Artificial Sequence
  Synthetic
cagtcatttgggtcggatccgtctgagc

SEQ ID NO: 7082 - DNA, 28 bp, Artificial Sequence
  Synthetic
cagtcatttgggtcacagtgaaccggtc

SEQ ID NO: 7083 - DNA, 28 bp, Artificial Sequence
  Synthetic
cagtcatttgggttgtccccttcaacca

SEQ ID NO: 7084 - DNA, 28 bp, Artificial Sequence
  Synthetic
cagtcatttgggtgtgactggttgacca

SEQ ID NO: 7085 - DNA, 28 bp, Artificial Sequence
  Synthetic
cagtcatttgggtatggctttttattcc

SEQ ID NO: 7086 - DNA, 28 bp, Artificial Sequence
  Synthetic
cagtcatttgggactccatttgttttga

SEQ ID NO: 7087 - DNA, 28 bp, Artificial Sequence
  Synthetic
cagtcatttgggaacactgtctggtaaa

SEQ ID NO: 7088 - DNA, 28 bp, Artificial Sequence
  Synthetic
cagtcatttgggtgagatgaagcactgt

SEQ ID NO: 7089 - DNA, 28 bp, Artificial Sequence
  Synthetic
cagtcatttgggtacagtatagatgatg

SEQ ID NO: 7090 - DNA, 28 bp, Artificial Sequence
  Synthetic
cagtcatttggggtccagttttcccagg

SEQ ID NO: 7091 - DNA, 28 bp, Artificial Sequence
  Synthetic
cagtcatttggggtgtgtggaaatgctt

SEQ ID NO: 7092 - DNA, 28 bp, Artificial Sequence
  Synthetic
cagtcatttgggttgcatagtcacaaaa

SEQ ID NO: 7093 - DNA, 28 bp, Artificial Sequence
  Synthetic
cagtcatttgggtaggttatccgtgttg

SEQ ID NO: 7094 - DNA, 28 bp, Artificial Sequence
  Synthetic
cagtcatttgggtagcagcacataatgg

SEQ ID NO: 7095 - DNA, 28 bp, Artificial Sequence
  Synthetic
cagtcatttgggtagcagcacatcatgg

SEQ ID NO: 7096 - DNA, 28 bp, Artificial Sequence
  Synthetic
cagtcatttgggtagcagcacgtaaata

SEQ ID NO: 7097 - DNA, 28 bp, Artificial Sequence
  Synthetic
cagtcatttgggactgcagtgaaggcac

SEQ ID NO: 7098 - DNA, 28 bp, Artificial Sequence
  Synthetic
cagtcatttgggcaaagtgcttacagtg

SEQ ID NO: 7099 - DNA, 28 bp, Artificial Sequence
  Synthetic
cagtcatttgggtaaggtgcatctagtg

SEQ ID NO: 7100 - DNA, 28 bp, Artificial Sequence
  Synthetic
cagtcatttgggaacattcaacgctgtc

SEQ ID NO: 7101 - DNA, 28 bp, Artificial Sequence
  Synthetic
cagtcatttgggaccatcgaccgttgat

SEQ ID NO: 7102 - DNA, 28 bp, Artificial Sequence
  Synthetic
cagtcatttgggaacattcattgctgtc

SEQ ID NO: 7103 - DNA, 28 bp, Artificial Sequence
  Synthetic
cagtcatttgggtttggcaatggtagaa

SEQ ID NO: 7104 - DNA, 28 bp, Artificial Sequence
  Synthetic
cagtcatttgggtggacggagaactgat

SEQ ID NO: 7105 - DNA, 28 bp, Artificial Sequence
  Synthetic
cagtcatttgggtcgtgtcttgtgttgc

SEQ ID NO: 7106 - DNA, 28 bp, Artificial Sequence
  Synthetic
cagtcatttgggcatcccttgcatggtg

SEQ ID NO: 7107 - DNA, 28 bp, Artificial Sequence
  Synthetic
cagtcatttggggtgcctactgagctga

SEQ ID NO: 7108 - DNA, 28 bp, Artificial Sequence
  Synthetic
cagtcatttgggtgtaacagcaactcca

SEQ ID NO: 7109 - DNA, 28 bp, Artificial Sequence
  Synthetic
cagtcatttgggtaggtagtttcatgtt

SEQ ID NO: 7110 - DNA, 28 bp, Artificial Sequence
  Synthetic
cagtcatttgggtaggtagtttcatgtt

SEQ ID NO: 7111 - DNA, 28 bp, Artificial Sequence
  Synthetic
cagtcatttgggttcaccaccttctcca

SEQ ID NO: 7112 - DNA, 28 bp, Artificial Sequence
  Synthetic
cagtcatttgggggtccagaggggagat

SEQ ID NO: 7113 - DNA, 28 bp, Artificial Sequence
  Synthetic
cagtcatttgggcccagtgttcagacta

SEQ ID NO: 7114 - DNA, 28 bp, Artificial Sequence
  Synthetic
cagtcatttgggtgtgcaaatctatgca

SEQ ID NO: 7115 - DNA, 28 bp, Artificial Sequence
  Synthetic
cagtcatttgggtgtgcaaatccatgca

SEQ ID NO: 7116 - DNA, 28 bp, Artificial Sequence
  Synthetic
cagtcatttgggtaaagtgcttatagtg

SEQ ID NO: 7117 - DNA, 28 bp, Artificial Sequence
  Synthetic
cagtcatttgggaatactgccgggtaat

SEQ ID NO: 7118 - DNA, 28 bp, Artificial Sequence
  Synthetic
cagtcatttgggttccctttgtcatcct

SEQ ID NO: 7119 - DNA, 28 bp, Artificial Sequence
  Synthetic
cagtcatttgggtggaatgtaaggaagt

SEQ ID NO: 7120 - DNA, 28 bp, Artificial Sequence
  Synthetic
cagtcatttgggtagcttatcagactga

SEQ ID NO: 7121 - DNA, 28 bp, Artificial Sequence
  Synthetic
cagtcatttgggttccctttgtcatcct

SEQ ID NO: 7122 - DNA, 28 bp, Artificial Sequence
  Synthetic
cagtcatttgggacagcaggcacagaca

SEQ ID NO: 7123 - DNA, 28 bp, Artificial Sequence
  Synthetic
cagtcatttgggatgacctatgaattga

SEQ ID NO: 7124 - DNA, 28 bp, Artificial Sequence
  Synthetic
cagtcatttgggtaatctcagctggcaa

SEQ ID NO: 7125 - DNA, 28 bp, Artificial Sequence
  Synthetic
cagtcatttgggttgtgcttgatctaac

SEQ ID NO: 7126 - DNA, 28 bp, Artificial Sequence
  Synthetic
cagtcatttgggtgattgtccaaacgca

SEQ ID NO: 7127 - DNA, 28 bp, Artificial Sequence
  Synthetic
cagtcatttgggaagctgccagttgaag

SEQ ID NO: 7128 - DNA, 28 bp, Artificial Sequence
  Synthetic
cagtcatttgggagctacattgtctgct

SEQ ID NO: 7129 - DNA, 28 bp, Artificial Sequence
  Synthetic
cagtcatttgggtgtcagtttgtcaaat

SEQ ID NO: 7130 - DNA, 28 bp, Artificial Sequence
  Synthetic
cagtcatttgggcaagtcactagtggtt

SEQ ID NO: 7131 - DNA, 28 bp, Artificial Sequence
  Synthetic
cagtcatttgggatcacattgccaggga

SEQ ID NO: 7132 - DNA, 28 bp, Artificial Sequence
  Synthetic
cagtcatttgggatcacattgccaggga

SEQ ID NO: 7133 - DNA, 28 bp, Artificial Sequence
  Synthetic
cagtcatttgggtggctcagttcagcag

SEQ ID NO: 7134 - DNA, 28 bp, Artificial Sequence
  Synthetic
cagtcatttgggcattgcacttgtctcg

SEQ ID NO: 7135 - DNA, 28 bp, Artificial Sequence
  Synthetic
cagtcatttgggttcaagtaatccagga

SEQ ID NO: 7136 - DNA, 28 bp, Artificial Sequence
  Synthetic
cagtcatttgggttcacagtggctaagt

SEQ ID NO: 7137 - DNA, 28 bp, Artificial Sequence
  Synthetic
cagtcatttgggaaggagctcacagtct

SEQ ID NO: 7138 - DNA, 28 bp, Artificial Sequence
  Synthetic
cagtcatttgggctagcaccatctgaaa

SEQ ID NO: 7139 - DNA, 28 bp, Artificial Sequence
  Synthetic
cagtcatttgggtagcaccatttgaaat

SEQ ID NO: 7140 - DNA, 28 bp, Artificial Sequence
  Synthetic
cagtcatttgggctttcagtcggatgtt

SEQ ID NO: 7141 - DNA, 28 bp, Artificial Sequence
  Synthetic
cagtcatttgggtgtaaacatcctcgac

SEQ ID NO: 7142 - DNA, 28 bp, Artificial Sequence
  Synthetic
cagtcatttgggggcaagatgctggcat

SEQ ID NO: 7143 - DNA, 28 bp, Artificial Sequence
  Synthetic
cagtcatttgggtattgcacattactaa

SEQ ID NO: 7144 - DNA, 28 bp, Artificial Sequence
  Synthetic
cagtcatttggggtgcattgtagttgca

SEQ ID NO: 7145 - DNA, 28 bp, Artificial Sequence
  Synthetic
cagtcatttgggtggcagtgtcttagct

SEQ ID NO: 7146 - DNA, 28 bp, Artificial Sequence
  Synthetic
cagtcatttgggtggaagactagtgatt

SEQ ID NO: 7147 - DNA, 28 bp, Artificial Sequence
  Synthetic
cagtcatttgggtattgcacttgtcccg

SEQ ID NO: 7148 - DNA, 28 bp, Artificial Sequence
  Synthetic
cagtcatttgggaaagtgctgttcgtgc

SEQ ID NO: 7149 - DNA, 28 bp, Artificial Sequence
  Synthetic
cagtcatttgggttcaacgggtatttat

SEQ ID NO: 7150 - DNA, 28 bp, Artificial Sequence
  Synthetic
cagtcatttgggtgaggtagtaagttgt

SEQ ID NO: 7151 - DNA, 28 bp, Artificial Sequence
  Synthetic
cagtcatttgggaacccgtagatccgat

SEQ ID NO: 7152 - DNA, 28 bp, Artificial Sequence
  Synthetic
cagtcatttgggtgacagaagagagtga

SEQ ID NO: 7153 - DNA, 28 bp, Artificial Sequence
  Synthetic
cagtcatttgggtgacagaagagagtga

SEQ ID NO: 7154 - DNA, 28 bp, Artificial Sequence
  Synthetic
cagtcatttgggtgacagaagagagtga

SEQ ID NO: 7155 - DNA, 28 bp, Artificial Sequence
  Synthetic
cagtcatttgggtgacagaagagagtga

SEQ ID NO: 7156 - DNA, 28 bp, Artificial Sequence
  Synthetic
cagtcatttgggtgacagaagagagtga

SEQ ID NO: 7157 - DNA, 28 bp, Artificial Sequence
  Synthetic
cagtcatttgggtgacagaagagagtga

SEQ ID NO: 7158 - DNA, 28 bp, Artificial Sequence
  Synthetic
cagtcatttgggttgacagaagatagag

SEQ ID NO: 7159 - DNA, 28 bp, Artificial Sequence
  Synthetic
cagtcatttgggttgacagaagatagag

SEQ ID NO: 7160 - DNA, 28 bp, Artificial Sequence
  Synthetic
cagtcatttgggttgacagaagatagag

SEQ ID NO: 7161 - DNA, 28 bp, Artificial Sequence
  Synthetic
cagtcatttgggttgacagaagatagag

SEQ ID NO: 7162 - DNA, 28 bp, Artificial Sequence
  Synthetic
cagtcatttgggtgacagaagagaggga

SEQ ID NO: 7163 - DNA, 28 bp, Artificial Sequence
  Synthetic
cagtcatttgggtttggattgaagggag

SEQ ID NO: 7164 - DNA, 28 bp, Artificial Sequence
  Synthetic
cagtcatttgggtttggattgaagggag

SEQ ID NO: 7165 - DNA, 28 bp, Artificial Sequence
  Synthetic
cagtcatttgggtttggattgaagggag

SEQ ID NO: 7166 - DNA, 28 bp, Artificial Sequence
  Synthetic
cagtcatttgggcttggattgaagggag

SEQ ID NO: 7167 - DNA, 28 bp, Artificial Sequence
  Synthetic
cagtcatttgggcttggggtgaagggag

SEQ ID NO: 7168 - DNA, 28 bp, Artificial Sequence
  Synthetic
cagtcatttgggattggagtgaagggag

SEQ ID NO: 7169 - DNA, 28 bp, Artificial Sequence
  Synthetic
cagtcatttgggtgcctggctccctgta

SEQ ID NO: 7170 - DNA, 28 bp, Artificial Sequence
  Synthetic
cagtcatttgggtgcctggctccctgta

SEQ ID NO: 7171 - DNA, 28 bp, Artificial Sequence
  Synthetic
cagtcatttgggtgcctggctccctgta

SEQ ID NO: 7172 - DNA, 28 bp, Artificial Sequence
  Synthetic
cagtcatttgggtgcctggctccctgta

SEQ ID NO: 7173 - DNA, 28 bp, Artificial Sequence
  Synthetic
cagtcatttgggtgcctggctccctgaa

SEQ ID NO: 7174 - DNA, 28 bp, Artificial Sequence
  Synthetic
cagtcatttgggtgcctggctccctgaa

SEQ ID NO: 7175 - DNA, 28 bp, Artificial Sequence
  Synthetic
cagtcatttgggtgcctggctccctgga

SEQ ID NO: 7176 - DNA, 28 bp, Artificial Sequence
  Synthetic
cagtcatttgggtgcctggctccctgca

SEQ ID NO: 7177 - DNA, 28 bp, Artificial Sequence
  Synthetic
cagtcatttgggtcgataaacctctgca

SEQ ID NO: 7178 - DNA, 28 bp, Artificial Sequence
  Synthetic
cagtcatttgggtcgataaacctctgca

SEQ ID NO: 7179 - DNA, 28 bp, Artificial Sequence
  Synthetic
cagtcatttgggtcgataaacctctgca

SEQ ID NO: 7180 - DNA, 28 bp, Artificial Sequence
  Synthetic
cagtcatttgggtggagaagcagggcac

SEQ ID NO: 7181 - DNA, 28 bp, Artificial Sequence
  Synthetic
cagtcatttgggtggagaagcagggcac

SEQ ID NO: 7182 - DNA, 28 bp, Artificial Sequence
  Synthetic
cagtcatttgggtggagaagcagggcac

SEQ ID NO: 7183 - DNA, 28 bp, Artificial Sequence
  Synthetic
cagtcatttgggtggagaagcagggcac

SEQ ID NO: 7184 - DNA, 28 bp, Artificial Sequence
  Synthetic
cagtcatttgggtggagaagcagggcac

SEQ ID NO: 7185 - DNA, 28 bp, Artificial Sequence
  Synthetic
cagtcatttgggtggagaagcagggcac

SEQ ID NO: 7186 - DNA, 28 bp, Artificial Sequence
  Synthetic
cagtcatttgggtcggaccaggcttcat

SEQ ID NO: 7187 - DNA, 28 bp, Artificial Sequence
  Synthetic
cagtcatttgggtcggaccaggcttcat

SEQ ID NO: 7188 - DNA, 28 bp, Artificial Sequence
  Synthetic
cagtcatttgggtcggaccaggcttcat

SEQ ID NO: 7189 - DNA, 28 bp, Artificial Sequence
  Synthetic
cagtcatttgggtcggaccaggcttcat

SEQ ID NO: 7190 - DNA, 28 bp, Artificial Sequence
  Synthetic
cagtcatttgggtcggaccaggcttcat

SEQ ID NO: 7191 - DNA, 28 bp, Artificial Sequence
  Synthetic
cagtcatttgggtcggaccaggcttcat

SEQ ID NO: 7192 - DNA, 28 bp, Artificial Sequence
  Synthetic
cagtcatttgggtcggaccaggcttcat

SEQ ID NO: 7193 - DNA, 28 bp, Artificial Sequence
  Synthetic
cagtcatttgggtcggaccaggcttcat

SEQ ID NO: 7194 - DNA, 28 bp, Artificial Sequence
  Synthetic
cagtcatttgggtcggaccaggcttcat

SEQ ID NO: 7195 - DNA, 28 bp, Artificial Sequence
  Synthetic
cagtcatttgggtcggaccaggcttcat

SEQ ID NO: 7196 - DNA, 28 bp, Artificial Sequence
  Synthetic
cagtcatttgggtcggaccaggcttcat

SEQ ID NO: 7197 - DNA, 28 bp, Artificial Sequence
  Synthetic
cagtcatttgggtcggaccaggcttcat

SEQ ID NO: 7198 - DNA, 28 bp, Artificial Sequence
  Synthetic
cagtcatttgggtcggaccaggcttcat

SEQ ID NO: 7199 - DNA, 28 bp, Artificial Sequence
  Synthetic
cagtcatttgggtcggaccaggcttcat

SEQ ID NO: 7200 - DNA, 28 bp, Artificial Sequence
  Synthetic
cagtcatttgggtcggaccaggcttcat

SEQ ID NO: 7201 - DNA, 28 bp, Artificial Sequence
  Synthetic
cagtcatttgggtcggaccaggctccat

SEQ ID NO: 7202 - DNA, 28 bp, Artificial Sequence
  Synthetic
cagtcatttgggtcggaccaggcttcat

SEQ ID NO: 7203 - DNA, 28 bp, Artificial Sequence
  Synthetic
cagtcatttgggtgaagctgccagcatg

SEQ ID NO: 7204 - DNA, 28 bp, Artificial Sequence
  Synthetic
cagtcatttgggtgaagctgccagcatg

SEQ ID NO: 7205 - DNA, 28 bp, Artificial Sequence
  Synthetic
cagtcatttgggtgaagctgccagcatg

SEQ ID NO: 7206 - DNA, 28 bp, Artificial Sequence
  Synthetic
cagtcatttgggtgaagctgccagcatg

SEQ ID NO: 7207 - DNA, 28 bp, Artificial Sequence
  Synthetic
cagtcatttgggtgaagctgccagcatg

SEQ ID NO: 7208 - DNA, 28 bp, Artificial Sequence
  Synthetic
cagtcatttgggtgaagctgccagcatg

SEQ ID NO: 7209 - DNA, 28 bp, Artificial Sequence
  Synthetic
cagtcatttgggtgaagctgccagcatg

SEQ ID NO: 7210 - DNA, 28 bp, Artificial Sequence
  Synthetic
cagtcatttgggtgaagctgccaacatg

SEQ ID NO: 7211 - DNA, 28 bp, Artificial Sequence
  Synthetic
cagtcatttgggtcgcttggtgcaggtc

SEQ ID NO: 7212 - DNA, 28 bp, Artificial Sequence
  Synthetic
cagtcatttgggtcgcttggtgcaggtc

SEQ ID NO: 7213 - DNA, 28 bp, Artificial Sequence
  Synthetic
cagtcatttgggcagccaaggatgactt

SEQ ID NO: 7214 - DNA, 28 bp, Artificial Sequence
  Synthetic
cagtcatttggggagccaagaatgactt

SEQ ID NO: 7215 - DNA, 28 bp, Artificial Sequence
  Synthetic
cagtcatttgggtagccaaggacgactt

SEQ ID NO: 7216 - DNA, 28 bp, Artificial Sequence
  Synthetic
cagtcatttgggtagccaaggacgactt

SEQ ID NO: 7217 - DNA, 28 bp, Artificial Sequence
  Synthetic
cagtcatttgggtagccaaggacgactt

SEQ ID NO: 7218 - DNA, 28 bp, Artificial Sequence
  Synthetic
cagtcatttgggtagccaaggacgactt

SEQ ID NO: 7219 - DNA, 28 bp, Artificial Sequence
  Synthetic
cagtcatttgggtagccaaggacgactt

SEQ ID NO: 7220 - DNA, 28 bp, Artificial Sequence
  Synthetic
cagtcatttgggcagccaaggatgactt

SEQ ID NO: 7221 - DNA, 28 bp, Artificial Sequence
  Synthetic
cagtcatttgggcagccaaggatgactt

SEQ ID NO: 7222 - DNA, 28 bp, Artificial Sequence
  Synthetic
cagtcatttgggcagccaaggatgactt

SEQ ID NO: 7223 - DNA, 28 bp, Artificial Sequence
  Synthetic
cagtcatttgggcagccaaggatgactt

SEQ ID NO: 7224 - DNA, 28 bp, Artificial Sequence
  Synthetic
cagtcatttgggcagccaaggatgactt

SEQ ID NO: 7225 - DNA, 28 bp, Artificial Sequence
  Synthetic
cagtcatttgggcagccaaggatgactt

SEQ ID NO: 7226 - DNA, 28 bp, Artificial Sequence
  Synthetic
cagtcatttgggcagccaaggatgactt

SEQ ID NO: 7227 - DNA, 28 bp, Artificial Sequence
  Synthetic
cagtcatttgggtagccaaggatgactt

SEQ ID NO: 7228 - DNA, 28 bp, Artificial Sequence
  Synthetic
cagtcatttgggtagccaaggatgactt

SEQ ID NO: 7229 - DNA, 28 bp, Artificial Sequence
  Synthetic
cagtcatttgggtagccaaggatgactt

SEQ ID NO: 7230 - DNA, 28 bp, Artificial Sequence
  Synthetic
cagtcatttgggtagccaaggatgactt

SEQ ID NO: 7231 - DNA, 28 bp, Artificial Sequence
  Synthetic
cagtcatttgggtagccaaggatgactt

SEQ ID NO: 7232 - DNA, 28 bp, Artificial Sequence
  Synthetic
cagtcatttgggtgagccaaggatgact

SEQ ID NO: 7233 - DNA, 28 bp, Artificial Sequence
  Synthetic
cagtcatttgggaagccaaggatgactt

SEQ ID NO: 7234 - DNA, 28 bp, Artificial Sequence
  Synthetic
cagtcatttgggaagccaaggatgactt

SEQ ID NO: 7235 - DNA, 28 bp, Artificial Sequence
  Synthetic
cagtcatttgggtagccaaggacgactt

SEQ ID NO: 7236 - DNA, 28 bp, Artificial Sequence
  Synthetic
cagtcatttgggtagccaaggatgactt

SEQ ID NO: 7237 - DNA, 28 bp, Artificial Sequence
  Synthetic
cagtcatttgggtcagccaaggatgact

SEQ ID NO: 7238 - DNA, 28 bp, Artificial Sequence
  Synthetic
cagtcatttggggagccaagaatgactt

SEQ ID NO: 7239 - DNA, 28 bp, Artificial Sequence
  Synthetic
cagtcatttgggtagccaaggacgactt

SEQ ID NO: 7240 - DNA, 28 bp, Artificial Sequence
  Synthetic
cagtcatttgggtagccaaggatgactt

SEQ ID NO: 7241 - DNA, 28 bp, Artificial Sequence
  Synthetic
cagtcatttgggtagccaaggatgactt

SEQ ID NO: 7242 - DNA, 28 bp, Artificial Sequence
  Synthetic
cagtcatttgggtagccaaggatgactt

SEQ ID NO: 7243 - DNA, 28 bp, Artificial Sequence
  Synthetic
cagtcatttgggtagccatggatgaatt

SEQ ID NO: 7244 - DNA, 28 bp, Artificial Sequence
  Synthetic
cagtcatttgggcagccaagaatgattt

SEQ ID NO: 7245 - DNA, 28 bp, Artificial Sequence
  Synthetic
cagtcatttgggttgagccgtgccaata

SEQ ID NO: 7246 - DNA, 28 bp, Artificial Sequence
  Synthetic
cagtcatttgggttgagccgtgccaata

SEQ ID NO: 7247 - DNA, 28 bp, Artificial Sequence
  Synthetic
cagtcatttgggagattgagccgcgcca

SEQ ID NO: 7248 - DNA, 28 bp, Artificial Sequence
  Synthetic
cagtcatttgggagattgagccgcgcca

SEQ ID NO: 7249 - DNA, 28 bp, Artificial Sequence
  Synthetic
cagtcatttgggtgattgagccgtgcca

SEQ ID NO: 7250 - DNA, 28 bp, Artificial Sequence
  Synthetic
cagtcatttgggtgattgagccgtgcca

SEQ ID NO: 7251 - DNA, 28 bp, Artificial Sequence
  Synthetic
cagtcatttgggtgattgagccgtgcca

SEQ ID NO: 7252 - DNA, 28 bp, Artificial Sequence
  Synthetic
cagtcatttgggtgattgagccgtgcca

SEQ ID NO: 7253 - DNA, 28 bp, Artificial Sequence
  Synthetic
cagtcatttgggtgattgagccgtgcca

SEQ ID NO: 7254 - DNA, 28 bp, Artificial Sequence
  Synthetic
cagtcatttgggggattgagccgcgcca

SEQ ID NO: 7255 - DNA, 28 bp, Artificial Sequence
  Synthetic
cagtcatttgggggattgagccgcgcca

SEQ ID NO: 7256 - DNA, 28 bp, Artificial Sequence
  Synthetic
cagtcatttgggagaatcttgatgatgc

SEQ ID NO: 7257 - DNA, 28 bp, Artificial Sequence
  Synthetic
cagtcatttgggagaatcttgatgatgc

SEQ ID NO: 7258 - DNA, 28 bp, Artificial Sequence
  Synthetic
cagtcatttgggagaatcttgatgatgc

SEQ ID NO: 7259 - DNA, 28 bp, Artificial Sequence
  Synthetic
cagtcatttgggggaatcttgatgatgc

SEQ ID NO: 7260 - DNA, 28 bp, Artificial Sequence
  Synthetic
cagtcatttgggggaatcttgatgatgc

SEQ ID NO: 7261 - DNA, 28 bp, Artificial Sequence
  Synthetic
cagtcatttgggagaatcttgatgatgc

SEQ ID NO: 7262 - DNA, 28 bp, Artificial Sequence
  Synthetic
cagtcatttgggggaatcttgatgatgc

SEQ ID NO: 7263 - DNA, 28 bp, Artificial Sequence
  Synthetic
cagtcatttgggggaatcttgatgatgc

SEQ ID NO: 7264 - DNA, 28 bp, Artificial Sequence
  Synthetic
cagtcatttgggagaatcctgatgatgc

SEQ ID NO: 7265 - DNA, 28 bp, Artificial Sequence
  Synthetic
cagtcatttgggttggactgaagggagc

SEQ ID NO: 7266 - DNA, 28 bp, Artificial Sequence
  Synthetic
cagtcatttgggttggactgaagggagc

SEQ ID NO: 7267 - DNA, 28 bp, Artificial Sequence
  Synthetic
cagtcatttgggttggactgaagggagc

SEQ ID NO: 7268 - DNA, 28 bp, Artificial Sequence
  Synthetic
cagtcatttgggttggactgaagggagc

SEQ ID NO: 7269 - DNA, 28 bp, Artificial Sequence
  Synthetic
cagtcatttgggttggactgaagggagc

SEQ ID NO: 7270 - DNA, 28 bp, Artificial Sequence
  Synthetic
cagtcatttgggttggactgaagggagc

SEQ ID NO: 7271 - DNA, 28 bp, Artificial Sequence
  Synthetic
cagtcatttgggttggactgaagggagc

SEQ ID NO: 7272 - DNA, 28 bp, Artificial Sequence
  Synthetic
cagtcatttgggttggactgaagggagc

SEQ ID NO: 7273 - DNA, 28 bp, Artificial Sequence
  Synthetic
cagtcatttgggttgggctgaagggagc

SEQ ID NO: 7274 - DNA, 28 bp, Artificial Sequence
  Synthetic
cagtcatttgggaagctcaggagggata

SEQ ID NO: 7275 - DNA, 28 bp, Artificial Sequence
  Synthetic
cagtcatttgggaagctcaggagggata

SEQ ID NO: 7276 - DNA, 28 bp, Artificial Sequence
  Synthetic
cagtcatttgggaagctcaggagggata

SEQ ID NO: 7277 - DNA, 28 bp, Artificial Sequence
  Synthetic
cagtcatttgggaagctcaggagggata

SEQ ID NO: 7278 - DNA, 28 bp, Artificial Sequence
  Synthetic
cagtcatttgggtccaaagggatcgcat

SEQ ID NO: 7279 - DNA, 28 bp, Artificial Sequence
  Synthetic
cagtcatttgggtccaaagggatcgcat

SEQ ID NO: 7280 - DNA, 28 bp, Artificial Sequence
  Synthetic
cagtcatttgggtccaaagggatcgcat

SEQ ID NO: 7281 - DNA, 28 bp, Artificial Sequence
  Synthetic
cagtcatttgggtccaaagggatcgcat

SEQ ID NO: 7282 - DNA, 28 bp, Artificial Sequence
  Synthetic
cagtcatttgggttggcattctgtccac

SEQ ID NO: 7283 - DNA, 28 bp, Artificial Sequence
  Synthetic
cagtcatttgggttggcattctgtccac

SEQ ID NO: 7284 - DNA, 28 bp, Artificial Sequence
  Synthetic
cagtcatttgggctgaagggtttggagg

SEQ ID NO: 7285 - DNA, 28 bp, Artificial Sequence
  Synthetic
cagtcatttgggctgaagtgtttggggg

SEQ ID NO: 7286 - DNA, 28 bp, Artificial Sequence
  Synthetic
cagtcatttgggctgaagtgtttggggg

SEQ ID NO: 7287 - DNA, 28 bp, Artificial Sequence
  Synthetic
cagtcatttgggctgaagtgtttggggg

SEQ ID NO: 7288 - DNA, 28 bp, Artificial Sequence
  Synthetic
cagtcatttgggctgaagtgtttggggg

SEQ ID NO: 7289 - DNA, 28 bp, Artificial Sequence
  Synthetic
cagtcatttgggctgaagtgtttggggg

SEQ ID NO: 7290 - DNA, 28 bp, Artificial Sequence
  Synthetic
cagtcatttgggctgaagtgtttggggg

SEQ ID NO: 7291 - DNA, 28 bp, Artificial Sequence
  Synthetic
cagtcatttgggctgaagtgtttggggg

SEQ ID NO: 7292 - DNA, 28 bp, Artificial Sequence
  Synthetic
cagtcatttgggctgaagtgtttggggg

SEQ ID NO: 7293 - DNA, 28 bp, Artificial Sequence
  Synthetic
cagtcatttgggctgaagtgtttggggg

SEQ ID NO: 7294 - DNA, 28 bp, Artificial Sequence
  Synthetic
cagtcatttgggttccacagctttcttg

SEQ ID NO: 7295 - DNA, 28 bp, Artificial Sequence
  Synthetic
cagtcatttgggttccacagctttcttg

SEQ ID NO: 7296 - DNA, 28 bp, Artificial Sequence
  Synthetic
cagtcatttgggttccacagctttcttg

SEQ ID NO: 7297 - DNA, 28 bp, Artificial Sequence
  Synthetic
cagtcatttgggttccacagctttcttg

SEQ ID NO: 7298 - DNA, 28 bp, Artificial Sequence
  Synthetic
cagtcatttgggttccacagctttcttg

SEQ ID NO: 7299 - DNA, 28 bp, Artificial Sequence
  Synthetic
cagtcatttgggttccacggctttcttg

SEQ ID NO: 7300 - DNA, 28 bp, Artificial Sequence
  Synthetic
cagtcatttgggttccacggctttcttg

SEQ ID NO: 7301 - DNA, 28 bp, Artificial Sequence
  Synthetic
cagtcatttgggtcattgagtgcagcgt

SEQ ID NO: 7302 - DNA, 28 bp, Artificial Sequence
  Synthetic
cagtcatttgggccattgagtgcagcgt

SEQ ID NO: 7303 - DNA, 28 bp, Artificial Sequence
  Synthetic
cagtcatttgggtcattgagtggagctt

SEQ ID NO: 7304 - DNA, 28 bp, Artificial Sequence
  Synthetic
cagtcatttgggtgtgttctcaggtcac

SEQ ID NO: 7305 - DNA, 28 bp, Artificial Sequence
  Synthetic
cagtcatttgggtgtgttctcaggtcgc

SEQ ID NO: 7306 - DNA, 28 bp, Artificial Sequence
  Synthetic
cagtcatttgggtgtgttctcaggtcgc

SEQ ID NO: 7307 - DNA, 28 bp, Artificial Sequence
  Synthetic
cagtcatttgggtgccaaaggagatttg

SEQ ID NO: 7308 - DNA, 28 bp, Artificial Sequence
  Synthetic
cagtcatttgggtgccaaaggagatttg

SEQ ID NO: 7309 - DNA, 28 bp, Artificial Sequence
  Synthetic
cagtcatttgggtgccaaaggagatttg

SEQ ID NO: 7310 - DNA, 28 bp, Artificial Sequence
  Synthetic
cagtcatttgggtgccaaagaagatttg

SEQ ID NO: 7311 - DNA, 28 bp, Artificial Sequence
  Synthetic
cagtcatttgggtgccaaagaagatttg

SEQ ID NO: 7312 - DNA, 28 bp, Artificial Sequence
  Synthetic
cagtcatttgggtgccaaaggagaattg

SEQ ID NO: 7313 - DNA, 28 bp, Artificial Sequence
  Synthetic
cagtcatttgggtgccaaaggagaattg

SEQ ID NO: 7314 - DNA, 28 bp, Artificial Sequence
  Synthetic
cagtcatttgggtgccaaaggagagttt

SEQ ID NO: 7315 - DNA, 28 bp, Artificial Sequence
  Synthetic
cagtcatttgggtgccaaaggagagttg

SEQ ID NO: 7316 - DNA, 28 bp, Artificial Sequence
  Synthetic
cagtcatttgggtgccaaaggagatttg

SEQ ID NO: 7317 - DNA, 28 bp, Artificial Sequence
  Synthetic
cagtcatttgggtgccaaaggagatttg

SEQ ID NO: 7318 - DNA, 28 bp, Artificial Sequence
  Synthetic
cagtcatttgggcgccaaaggagagttg

SEQ ID NO: 7319 - DNA, 28 bp, Artificial Sequence
  Synthetic
cagtcatttgggttagattcacgcacaa

SEQ ID NO: 7320 - DNA, 28 bp, Artificial Sequence
  Synthetic
cagtcatttgggttagattcacgcacaa

SEQ ID NO: 7321 - DNA, 28 bp, Artificial Sequence
  Synthetic
cagtcatttgggttagattcacgcacaa

SEQ ID NO: 7322 - DNA, 28 bp, Artificial Sequence
  Synthetic
cagtcatttgggatgcactgcctcttcc

SEQ ID NO: 7323 - DNA, 28 bp, Artificial Sequence
  Synthetic
cagtcatttgggttttccctactccacc

SEQ ID NO: 7324 - DNA, 28 bp, Artificial Sequence
  Synthetic
cagtcatttgggttttcccaactccacc

SEQ ID NO: 7325 - DNA, 28 bp, Artificial Sequence
  Synthetic
cagtcatttgggactctccctcaaggct

SEQ ID NO: 7326 - DNA, 28 bp, Artificial Sequence
  Synthetic
cagtcatttggggctctccctcagggct

SEQ ID NO: 7327 - DNA, 28 bp, Artificial Sequence
  Synthetic
cagtcatttgggcaaaagttgctgggtt

SEQ ID NO: 7328 - DNA, 28 bp, Artificial Sequence
  Synthetic
cagtcatttgggcaaaagttgttgggtt

SEQ ID NO: 7329 - DNA, 28 bp, Artificial Sequence
  Synthetic
cagtcatttgggcaaaagctgttgggtt

SEQ ID NO: 7330 - DNA, 28 bp, Artificial Sequence
  Synthetic
cagtcatttgggttacagtgcccattga

SEQ ID NO: 7331 - DNA, 28 bp, Artificial Sequence
  Synthetic
cagtcatttgggttacagtgcccattga

SEQ ID NO: 7332 - DNA, 28 bp, Artificial Sequence
  Synthetic
cagtcatttgggttacaatgtccattga

SEQ ID NO: 7333 - DNA, 28 bp, Artificial Sequence
  Synthetic
cagtcatttgggttacagagtccattga

SEQ ID NO: 7334 - DNA, 28 bp, Artificial Sequence
  Synthetic
cagtcatttgggtagtaatccttctttg

SEQ ID NO: 7335 - DNA, 28 bp, Artificial Sequence
  Synthetic
cagtcatttgggtagtaattcttctttg

SEQ ID NO: 7336 - DNA, 28 bp, Artificial Sequence
  Synthetic
cagtcatttgggtagtaattcttctttg

SEQ ID NO: 7337 - DNA, 28 bp, Artificial Sequence
  Synthetic
cagtcatttgggatctccctcagaggct

SEQ ID NO: 7338 - DNA, 28 bp, Artificial Sequence
  Synthetic
cagtcatttgggatctccctcagaggct

SEQ ID NO: 7339 - DNA, 28 bp, Artificial Sequence
  Synthetic
cagtcatttgggtgacgtgtcttctatt

SEQ ID NO: 7340 - DNA, 28 bp, Artificial Sequence
  Synthetic
cagtcatttgggtgacgtgtcttctatt

SEQ ID NO: 7341 - DNA, 28 bp, Artificial Sequence
  Synthetic
cagtcatttgggtgacgtgtcttctatt

SEQ ID NO: 7342 - DNA, 28 bp, Artificial Sequence
  Synthetic
cagtcatttgggtgacgtgtcttctatt

SEQ ID NO: 7343 - DNA, 28 bp, Artificial Sequence
  Synthetic
cagtcatttgggtgacgagtcttctatt

SEQ ID NO: 7344 - DNA, 28 bp, Artificial Sequence
  Synthetic
cagtcatttgggtgacatgtcttctatt

SEQ ID NO: 7345 - DNA, 28 bp, Artificial Sequence
  Synthetic
cagtcatttgggtaacgtgtctcctatt

SEQ ID NO: 7346 - DNA, 28 bp, Artificial Sequence
  Synthetic
cagtcatttgggtaacgtgtctcctatt

SEQ ID NO: 7347 - DNA, 28 bp, Artificial Sequence
  Synthetic
cagtcatttgggtaacgtgtctcctatt

SEQ ID NO: 7348 - DNA, 28 bp, Artificial Sequence
  Synthetic
cagtcatttgggtaacgtgtctcctatt

SEQ ID NO: 7349 - DNA, 28 bp, Artificial Sequence
  Synthetic
cagtcatttgggtaacgtgtctcctatt

SEQ ID NO: 7350 - DNA, 28 bp, Artificial Sequence
  Synthetic
cagtcatttgggtaacgtgtctcctatt

SEQ ID NO: 7351 - DNA, 28 bp, Artificial Sequence
  Synthetic
cagtcatttgggtaacgtgtctcctatt

SEQ ID NO: 7352 - DNA, 28 bp, Artificial Sequence
  Synthetic
cagtcatttgggtaacgtgtctcctatt

SEQ ID NO: 7353 - DNA, 28 bp, Artificial Sequence
  Synthetic
cagtcatttgggtaacgtgtctcctatt

SEQ ID NO: 7354 - DNA, 28 bp, Artificial Sequence
  Synthetic
cagtcatttgggtaacgtgtctcctatt

SEQ ID NO: 7355 - DNA, 28 bp, Artificial Sequence
  Synthetic
cagtcatttgggtaacgtgtctcctatt

SEQ ID NO: 7356 - DNA, 28 bp, Artificial Sequence
  Synthetic
cagtcatttgggtaacgtgtctcctatt

SEQ ID NO: 7357 - DNA, 28 bp, Artificial Sequence
  Synthetic
cagtcatttgggtaacgtgtctcctatt

SEQ ID NO: 7358 - DNA, 28 bp, Artificial Sequence
  Synthetic
cagtcatttgggtgtgatattggtccgg

SEQ ID NO: 7359 - DNA, 28 bp, Artificial Sequence
  Synthetic
cagtcatttgggactactacatcattga

SEQ ID NO: 7360 - DNA, 28 bp, Artificial Sequence
  Synthetic
cagtcatttgggactactacatcattga

SEQ ID NO: 7361 - DNA, 28 bp, Artificial Sequence
  Synthetic
cagtcatttgggaggacctcacttaaca

SEQ ID NO: 7362 - DNA, 28 bp, Artificial Sequence
  Synthetic
cagtcatttgggaggacctcacttaaca

SEQ ID NO: 7363 - DNA, 28 bp, Artificial Sequence
  Synthetic
cagtcatttgggaggacctcacttaaca

SEQ ID NO: 7364 - DNA, 28 bp, Artificial Sequence
  Synthetic
cagtcatttgggaagacctcacctaaca

SEQ ID NO: 7365 - DNA, 28 bp, Artificial Sequence
  Synthetic
cagtcatttgggaggacctcacctaaca

SEQ ID NO: 7366 - DNA, 28 bp, Artificial Sequence
  Synthetic
cagtcatttgggcctactcctcccattc

SEQ ID NO: 7367 - DNA, 28 bp, Artificial Sequence
  Synthetic
cagtcatttgggaacccgtagatccgaa

SEQ ID NO: 7368 - DNA, 28 bp, Artificial Sequence
  Synthetic
cagtcatttgggtacagtactgtgataa

SEQ ID NO: 7369 - DNA, 28 bp, Artificial Sequence
  Synthetic
cagtcatttgggagcagcattgtacagg

SEQ ID NO: 7370 - DNA, 28 bp, Artificial Sequence
  Synthetic
cagtcatttgggtcaaatgctcagactc

SEQ ID NO: 7371 - DNA, 28 bp, Artificial Sequence
  Synthetic
cagtcatttgggaaaagtgcttacagtg

SEQ ID NO: 7372 - DNA, 28 bp, Artificial Sequence
  Synthetic
cagtcatttgggtaaagtgctgacagtg

SEQ ID NO: 7373 - DNA, 28 bp, Artificial Sequence
  Synthetic
cagtcatttgggagcagcattgtacagg

SEQ ID NO: 7374 - DNA, 28 bp, Artificial Sequence
  Synthetic
cagtcatttgggttaaggcacgcggtga

SEQ ID NO: 7375 - DNA, 28 bp, Artificial Sequence
  Synthetic
cagtcatttgggtccctgagaccctaac

SEQ ID NO: 7376 - DNA, 28 bp, Artificial Sequence
  Synthetic
cagtcatttgggtcggatccgtctgagc

SEQ ID NO: 7377 - DNA, 28 bp, Artificial Sequence
  Synthetic
cagtcatttgggtcacagtgaaccggtc

SEQ ID NO: 7378 - DNA, 28 bp, Artificial Sequence
  Synthetic
cagtcatttgggttggtccccttcaacc

SEQ ID NO: 7379 - DNA, 28 bp, Artificial Sequence
  Synthetic
cagtcatttgggtatggctttttattcc

SEQ ID NO: 7380 - DNA, 28 bp, Artificial Sequence
  Synthetic
cagtcatttgggactccatttgttttga

SEQ ID NO: 7381 - DNA, 28 bp, Artificial Sequence
  Synthetic
cagtcatttgggagtggttttaccctat

SEQ ID NO: 7382 - DNA, 28 bp, Artificial Sequence
  Synthetic
cagtcatttgggtgagatgaagcactgt

SEQ ID NO: 7383 - DNA, 28 bp, Artificial Sequence
  Synthetic
cagtcatttgggtacagtatagatgatg

SEQ ID NO: 7384 - DNA, 28 bp, Artificial Sequence
  Synthetic
cagtcatttggggtccagttttcccagg

SEQ ID NO: 7385 - DNA, 28 bp, Artificial Sequence
  Synthetic
cagtcatttggggtgtgtggaaatgctt

SEQ ID NO: 7386 - DNA, 28 bp, Artificial Sequence
  Synthetic
cagtcatttgggtaggttatccgtgttg

SEQ ID NO: 7387 - DNA, 28 bp, Artificial Sequence
  Synthetic
cagtcatttgggtagcagcacataatgg

SEQ ID NO: 7388 - DNA, 28 bp, Artificial Sequence
  Synthetic
cagtcatttgggtagcagcacatcatgg

SEQ ID NO: 7389 - DNA, 28 bp, Artificial Sequence
  Synthetic
cagtcatttgggtagcagcacgtaaata

SEQ ID NO: 7390 - DNA, 28 bp, Artificial Sequence
  Synthetic
cagtcatttgggactgcagtgaaggcac

SEQ ID NO: 7391 - DNA, 28 bp, Artificial Sequence
  Synthetic
cagtcatttgggcaaagtgcttacagtg

SEQ ID NO: 7392 - DNA, 28 bp, Artificial Sequence
  Synthetic
cagtcatttgggtaaggtgcatctagtg

SEQ ID NO: 7393 - DNA, 28 bp, Artificial Sequence
  Synthetic
cagtcatttgggaacattcaacgctgtc

SEQ ID NO: 7394 - DNA, 28 bp, Artificial Sequence
  Synthetic
cagtcatttgggaccatcgaccgttgat

SEQ ID NO: 7395 - DNA, 28 bp, Artificial Sequence
  Synthetic
cagtcatttgggaacattcattgctgtc

SEQ ID NO: 7396 - DNA, 28 bp, Artificial Sequence
  Synthetic
cagtcatttgggaacattcaacctgtcg

SEQ ID NO: 7397 - DNA, 28 bp, Artificial Sequence
  Synthetic
cagtcatttgggtatggcactggtagaa

SEQ ID NO: 7398 - DNA, 28 bp, Artificial Sequence
  Synthetic
cagtcatttgggtggacggagaactgat

SEQ ID NO: 7399 - DNA, 28 bp, Artificial Sequence
  Synthetic
cagtcatttgggcaaagaattctccttt

SEQ ID NO: 7400 - DNA, 28 bp, Artificial Sequence
  Synthetic
cagtcatttgggcatcccttgcatggtg

SEQ ID NO: 7401 - DNA, 28 bp, Artificial Sequence
  Synthetic
cagtcatttgggtgatatgtttgatata

SEQ ID NO: 7402 - DNA, 28 bp, Artificial Sequence
  Synthetic
cagtcatttgggtgtaacagcaactcca

SEQ ID NO: 7403 - DNA, 28 bp, Artificial Sequence
  Synthetic
cagtcatttgggtaggtagtttcatgtt

SEQ ID NO: 7404 - DNA, 28 bp, Artificial Sequence
  Synthetic
cagtcatttgggttcaccaccttctcca

SEQ ID NO: 7405 - DNA, 28 bp, Artificial Sequence
  Synthetic
cagtcatttgggggtccagaggggagat

SEQ ID NO: 7406 - DNA, 28 bp, Artificial Sequence
  Synthetic
cagtcatttgggcccagtgttcagacta

SEQ ID NO: 7407 - DNA, 28 bp, Artificial Sequence
  Synthetic
cagtcatttgggtgtgcaaatctatgca

SEQ ID NO: 7408 - DNA, 28 bp, Artificial Sequence
  Synthetic
cagtcatttgggtgtgcaaatccatgca

SEQ ID NO: 7409 - DNA, 28 bp, Artificial Sequence
  Synthetic
cagtcatttgggtaaagtgcttatagtg

SEQ ID NO: 7410 - DNA, 28 bp, Artificial Sequence
  Synthetic
cagtcatttgggttccctttgtcatcct

SEQ ID NO: 7411 - DNA, 28 bp, Artificial Sequence
  Synthetic
cagtcatttgggtccttcattccaccgg

SEQ ID NO: 7412 - DNA, 28 bp, Artificial Sequence
  Synthetic
cagtcatttgggtagcttatcagactga

SEQ ID NO: 7413 - DNA, 28 bp, Artificial Sequence
  Synthetic
cagtcatttgggacagcaggcacagaca

SEQ ID NO: 7414 - DNA, 28 bp, Artificial Sequence
  Synthetic
cagtcatttgggatgacctatgaattga

SEQ ID NO: 7415 - DNA, 28 bp, Artificial Sequence
  Synthetic
cagtcatttgggtaatctcagctggcaa

SEQ ID NO: 7416 - DNA, 28 bp, Artificial Sequence
  Synthetic
cagtcatttgggttgtgcttgatctaac

SEQ ID NO: 7417 - DNA, 28 bp, Artificial Sequence
  Synthetic
cagtcatttgggaagctgccagttgaag

SEQ ID NO: 7418 - DNA, 28 bp, Artificial Sequence
  Synthetic
cagtcatttgggccacaccgtatctgac

SEQ ID NO: 7419 - DNA, 28 bp, Artificial Sequence
  Synthetic
cagtcatttgggtgtcagtttgtcaaat

SEQ ID NO: 7420 - DNA, 28 bp, Artificial Sequence
  Synthetic
cagtcatttgggcaagtcactagtggtt

SEQ ID NO: 7421 - DNA, 28 bp, Artificial Sequence
  Synthetic
cagtcatttgggatcacattgccaggga

SEQ ID NO: 7422 - DNA, 28 bp, Artificial Sequence
  Synthetic
cagtcatttgggatcacattgccaggga

SEQ ID NO: 7423 - DNA, 28 bp, Artificial Sequence
  Synthetic
cagtcatttgggtggctcagttcagcag

SEQ ID NO: 7424 - DNA, 28 bp, Artificial Sequence
  Synthetic
cagtcatttgggcattgcacttgtctcg

SEQ ID NO: 7425 - DNA, 28 bp, Artificial Sequence
  Synthetic
cagtcatttgggttcaagtaatccagga

SEQ ID NO: 7426 - DNA, 28 bp, Artificial Sequence
  Synthetic
cagtcatttgggttcacagtggctaagt

SEQ ID NO: 7427 - DNA, 28 bp, Artificial Sequence
  Synthetic
cagtcatttgggaaggagctcacagtct

SEQ ID NO: 7428 - DNA, 28 bp, Artificial Sequence
  Synthetic
cagtcatttgggctagcaccatctgaaa

SEQ ID NO: 7429 - DNA, 28 bp, Artificial Sequence
  Synthetic
cagtcatttgggtagcaccatttgaaat

SEQ ID NO: 7430 - DNA, 28 bp, Artificial Sequence
  Synthetic
cagtcatttgggctttcagtcggatgtt

SEQ ID NO: 7431 - DNA, 28 bp, Artificial Sequence
  Synthetic
cagtcatttgggtgtaaacatcctcgac

SEQ ID NO: 7432 - DNA, 28 bp, Artificial Sequence
  Synthetic
cagtcatttgggtgtaaacatcctacac

SEQ ID NO: 7433 - DNA, 28 bp, Artificial Sequence
  Synthetic
cagtcatttgggtgtaaacatcctacac

SEQ ID NO: 7434 - DNA, 28 bp, Artificial Sequence
  Synthetic
cagtcatttgggtgtaaacatccccgac

SEQ ID NO: 7435 - DNA, 28 bp, Artificial Sequence
  Synthetic
cagtcatttgggggcaagatgctggcat

SEQ ID NO: 7436 - DNA, 28 bp, Artificial Sequence
  Synthetic
cagtcatttgggtattgcacattactaa

SEQ ID NO: 7437 - DNA, 28 bp, Artificial Sequence
  Synthetic
cagtcatttggggtgcattgtagttgca

SEQ ID NO: 7438 - DNA, 28 bp, Artificial Sequence
  Synthetic
cagtcatttgggtggcagtgtcttagct

SEQ ID NO: 7439 - DNA, 28 bp, Artificial Sequence
  Synthetic
cagtcatttgggtggaagactagtgatt

SEQ ID NO: 7440 - DNA, 28 bp, Artificial Sequence
  Synthetic
cagtcatttgggtctttggttatctagc

SEQ ID NO: 7441 - DNA, 28 bp, Artificial Sequence
  Synthetic
cagtcatttgggtattgcacttgtcccg

SEQ ID NO: 7442 - DNA, 28 bp, Artificial Sequence
  Synthetic
cagtcatttgggaaagtgctgttcgtgc

SEQ ID NO: 7443 - DNA, 28 bp, Artificial Sequence
  Synthetic
cagtcatttgggttcaacgggtatttat

SEQ ID NO: 7444 - DNA, 28 bp, Artificial Sequence
  Synthetic
cagtcatttgggtttggcactagcacat

SEQ ID NO: 7445 - DNA, 28 bp, Artificial Sequence
  Synthetic
cagtcatttgggtgaggtagtaagttgt

SEQ ID NO: 7446 - DNA, 28 bp, Artificial Sequence
  Synthetic
cagtcatttgggaacccgtagatccgat

SEQ ID NO: 7447 - DNA, 28 bp, Artificial Sequence
  Synthetic
cagtcatttgggtaacctgatcagcccc

SEQ ID NO: 7448 - DNA, 28 bp, Artificial Sequence
  Synthetic
cagtcatttgggtagtgcgccggtgacc

SEQ ID NO: 7449 - DNA, 28 bp, Artificial Sequence
  Synthetic
cagtcatttgggtgacactcgataggat

SEQ ID NO: 7450 - DNA, 28 bp, Artificial Sequence
  Synthetic
cagtcatttgggaacggtgcatggactg

SEQ ID NO: 7451 - DNA, 28 bp, Artificial Sequence
  Synthetic
cagtcatttgggagaccagaccatgcac

SEQ ID NO: 7452 - DNA, 28 bp, Artificial Sequence
  Synthetic
cagtcatttggggatcatagccagtgtc

SEQ ID NO: 7453 - DNA, 28 bp, Artificial Sequence
  Synthetic
cagtcatttgggtcgcacatcaggctga

SEQ ID NO: 7454 - DNA, 28 bp, Artificial Sequence
  Synthetic
cagtcatttgggtcggacggtctggtgc

SEQ ID NO: 7455 - DNA, 28 bp, Artificial Sequence
  Synthetic
cagtcatttgggtcctgtagagtatggg

SEQ ID NO: 7456 - DNA, 28 bp, Artificial Sequence
  Synthetic
cagtcatttgggcatgaaacacatggcc

SEQ ID NO: 7457 - DNA, 28 bp, Artificial Sequence
  Synthetic
cagtcatttgggagcaggcatgtcttca

SEQ ID NO: 7458 - DNA, 28 bp, Artificial Sequence
  Synthetic
cagtcatttgggtatcttttgcggggga

SEQ ID NO: 7459 - DNA, 28 bp, Artificial Sequence
  Synthetic
cagtcatttgggcgcacctcgccgtctc

SEQ ID NO: 7460 - DNA, 28 bp, Artificial Sequence
  Synthetic
cagtcatttgggcaccacacgatccact

SEQ ID NO: 7461 - DNA, 28 bp, Artificial Sequence
  Synthetic
cagtcatttgggacctagtaattgtgcg

SEQ ID NO: 7462 - DNA, 28 bp, Artificial Sequence
  Synthetic
cagtcatttgggcgcaccacttttcact

SEQ ID NO: 7463 - DNA, 28 bp, Artificial Sequence
  Synthetic
cagtcatttgggaacctagtgccggtga

SEQ ID NO: 7464 - DNA, 28 bp, Artificial Sequence
  Synthetic
cagtcatttgggtagcaccgctatccac

SEQ ID NO: 7465 - DNA, 28 bp, Artificial Sequence
  Synthetic
cagtcatttgggtttagtggaagtgacg

SEQ ID NO: 7466 - DNA, 28 bp, Artificial Sequence
  Synthetic
cagtcatttgggcgaggtaaacatcggc

SEQ ID NO: 7467 - DNA, 28 bp, Artificial Sequence
  Synthetic
cagtcatttgggtaaggtgaatatagct

SEQ ID NO: 7468 - DNA, 28 bp, Artificial Sequence
  Synthetic
cagtcatttgggtcgatgcatggtcccc

SEQ ID NO: 7469 - DNA, 28 bp, Artificial Sequence
  Synthetic
cagtcatttgggtgaggtagtaggttgt

SEQ ID NO: 7470 - DNA, 28 bp, Artificial Sequence
  Synthetic
cagtcatttgggtgaggtagtaggttgt

SEQ ID NO: 7471 - DNA, 28 bp, Artificial Sequence
  Synthetic
cagtcatttgggtgaggtagtaggttgt

SEQ ID NO: 7472 - DNA, 28 bp, Artificial Sequence
  Synthetic
cagtcatttgggagaggtagtaggttgc

SEQ ID NO: 7473 - DNA, 28 bp, Artificial Sequence
  Synthetic
cagtcatttgggctatacgacctgctgc

SEQ ID NO: 7474 - DNA, 28 bp, Artificial Sequence
  Synthetic
cagtcatttgggtgaggtaggaggttgt

SEQ ID NO: 7475 - DNA, 28 bp, Artificial Sequence
  Synthetic
cagtcatttgggtgaggtagtagattgt

SEQ ID NO: 7476 - DNA, 28 bp, Artificial Sequence
  Synthetic
cagtcatttgggtgaggtagtagtttgt

SEQ ID NO: 7477 - DNA, 28 bp, Artificial Sequence
  Synthetic
cagtcatttgggtggaatgtaaagaagt

SEQ ID NO: 7478 - DNA, 28 bp, Artificial Sequence
  Synthetic
cagtcatttggggcacatacttctttat

SEQ ID NO: 7479 - DNA, 28 bp, Artificial Sequence
  Synthetic
cagtcatttgggaacccgtagatccgaa

SEQ ID NO: 7480 - DNA, 28 bp, Artificial Sequence
  Synthetic
cagtcatttgggtacagtactgtgataa

SEQ ID NO: 7481 - DNA, 28 bp, Artificial Sequence
  Synthetic
cagtcatttgggtacagtactgtgatag

SEQ ID NO: 7482 - DNA, 28 bp, Artificial Sequence
  Synthetic
cagtcatttgggagcagcattgtacagg

SEQ ID NO: 7483 - DNA, 28 bp, Artificial Sequence
  Synthetic
cagtcatttgggtaaagtgctgacagtg

SEQ ID NO: 7484 - DNA, 28 bp, Artificial Sequence
  Synthetic
cagtcatttgggagcagcattgtacagg

SEQ ID NO: 7485 - DNA, 28 bp, Artificial Sequence
  Synthetic
cagtcatttgggtaccctgtagatccga

SEQ ID NO: 7486 - DNA, 28 bp, Artificial Sequence
  Synthetic
cagtcatttgggccctgtagaaccgaat

SEQ ID NO: 7487 - DNA, 28 bp, Artificial Sequence
  Synthetic
cagtcatttgggtggagtgtgacaatgg

SEQ ID NO: 7488 - DNA, 28 bp, Artificial Sequence
  Synthetic
cagtcatttgggttaaggcacgcggtga

SEQ ID NO: 7489 - DNA, 28 bp, Artificial Sequence
  Synthetic
cagtcatttgggtccctgagacccttta

SEQ ID NO: 7490 - DNA, 28 bp, Artificial Sequence
  Synthetic
cagtcatttgggtccctgagaccctaac

SEQ ID NO: 7491 - DNA, 28 bp, Artificial Sequence
  Synthetic
cagtcatttgggtcgtaccgtgagtaat

SEQ ID NO: 7492 - DNA, 28 bp, Artificial Sequence
  Synthetic
cagtcatttgggcattattacttttggt

SEQ ID NO: 7493 - DNA, 28 bp, Artificial Sequence
  Synthetic
cagtcatttgggtcggatccgtctgagc

SEQ ID NO: 7494 - DNA, 28 bp, Artificial Sequence
  Synthetic
cagtcatttgggtcacagtgaaccggtc

SEQ ID NO: 7495 - DNA, 28 bp, Artificial Sequence
  Synthetic
cagtcatttgggtcacagtgaaccggtc

SEQ ID NO: 7496 - DNA, 28 bp, Artificial Sequence
  Synthetic
cagtcatttgggctttttgcggtctggg

SEQ ID NO: 7497 - DNA, 28 bp, Artificial Sequence
  Synthetic
cagtcatttgggaagcccttaccccaaa

SEQ ID NO: 7498 - DNA, 28 bp, Artificial Sequence
  Synthetic
cagtcatttgggcagtgcaatgttaaaa

SEQ ID NO: 7499 - DNA, 28 bp, Artificial Sequence
  Synthetic
cagtcatttgggcagtgcaatgatgaaa

SEQ ID NO: 7500 - DNA, 28 bp, Artificial Sequence
  Synthetic
cagtcatttgggtaacagtctacagcca

SEQ ID NO: 7501 - DNA, 28 bp, Artificial Sequence
  Synthetic
cagtcatttgggttggtccccttcaacc

SEQ ID NO: 7502 - DNA, 28 bp, Artificial Sequence
  Synthetic
cagtcatttgggttggtccccttcaacc

SEQ ID NO: 7503 - DNA, 28 bp, Artificial Sequence
  Synthetic
cagtcatttgggtgtgactggttgacca

SEQ ID NO: 7504 - DNA, 28 bp, Artificial Sequence
  Synthetic
cagtcatttgggtatggctttttattcc

SEQ ID NO: 7505 - DNA, 28 bp, Artificial Sequence
  Synthetic
cagtcatttgggtatggcttttcattcc

SEQ ID NO: 7506 - DNA, 28 bp, Artificial Sequence
  Synthetic
cagtcatttgggactccatttgttttga

SEQ ID NO: 7507 - DNA, 28 bp, Artificial Sequence
  Synthetic
cagtcatttgggtattgcttaagaatac

SEQ ID NO: 7508 - DNA, 28 bp, Artificial Sequence
  Synthetic
cagtcatttgggagctggtgttgtgaat

SEQ ID NO: 7509 - DNA, 28 bp, Artificial Sequence
  Synthetic
cagtcatttgggtctacagtgcacgtgt

SEQ ID NO: 7510 - DNA, 28 bp, Artificial Sequence
  Synthetic
cagtcatttgggagtggttttaccctat

SEQ ID NO: 7511 - DNA, 28 bp, Artificial Sequence
  Synthetic
cagtcatttgggtaccacagggtagaac

SEQ ID NO: 7512 - DNA, 28 bp, Artificial Sequence
  Synthetic
cagtcatttgggtaacactgtctggtaa

SEQ ID NO: 7513 - DNA, 28 bp, Artificial Sequence
  Synthetic
cagtcatttgggtgtagtgtttcctact

SEQ ID NO: 7514 - DNA, 28 bp, Artificial Sequence
  Synthetic
cagtcatttgggcataaagtagaaagca

SEQ ID NO: 7515 - DNA, 28 bp, Artificial Sequence
  Synthetic
cagtcatttgggtgagatgaagcactgt

SEQ ID NO: 7516 - DNA, 28 bp, Artificial Sequence
  Synthetic
cagtcatttgggtacagtatagatgatg

SEQ ID NO: 7517 - DNA, 28 bp, Artificial Sequence
  Synthetic
cagtcatttggggtccagttttcccagg

SEQ ID NO: 7518 - DNA, 28 bp, Artificial Sequence
  Synthetic
cagtcatttgggtgagaactgaattcca

SEQ ID NO: 7519 - DNA, 28 bp, Artificial Sequence
  Synthetic
cagtcatttgggtcagtgcatcacagaa

SEQ ID NO: 7520 - DNA, 28 bp, Artificial Sequence
  Synthetic
cagtcatttgggtctcccaacccttgta

SEQ ID NO: 7521 - DNA, 28 bp, Artificial Sequence
  Synthetic
cagtcatttgggactagactgaggctcc

SEQ ID NO: 7522 - DNA, 28 bp, Artificial Sequence
  Synthetic
cagtcatttgggtcgaggagctcacagt

SEQ ID NO: 7523 - DNA, 28 bp, Artificial Sequence
  Synthetic
cagtcatttgggtcagtgcatgacagaa

SEQ ID NO: 7524 - DNA, 28 bp, Artificial Sequence
  Synthetic
cagtcatttgggttgcatagtcacaaaa

SEQ ID NO: 7525 - DNA, 28 bp, Artificial Sequence
  Synthetic
cagtcatttgggtaggttatccgtgttg

SEQ ID NO: 7526 - DNA, 28 bp, Artificial Sequence
  Synthetic
cagtcatttgggtagcagcacatcatgg

SEQ ID NO: 7527 - DNA, 28 bp, Artificial Sequence
  Synthetic
cagtcatttgggtagcagcacgtaaata

SEQ ID NO: 7528 - DNA, 28 bp, Artificial Sequence
  Synthetic
cagtcatttgggcaaagtgcttacagtg

SEQ ID NO: 7529 - DNA, 28 bp, Artificial Sequence
  Synthetic
cagtcatttgggtaaggtgcatctagtg

SEQ ID NO: 7530 - DNA, 28 bp, Artificial Sequence
  Synthetic
cagtcatttgggaacattcaacgctgtc

SEQ ID NO: 7531 - DNA, 28 bp, Artificial Sequence
  Synthetic
cagtcatttgggaccatcgaccgttgat

SEQ ID NO: 7532 - DNA, 28 bp, Artificial Sequence
  Synthetic
cagtcatttgggaacattcattgctgtc

SEQ ID NO: 7533 - DNA, 28 bp, Artificial Sequence
  Synthetic
cagtcatttgggaacattcaacctgtcg

SEQ ID NO: 7534 - DNA, 28 bp, Artificial Sequence
  Synthetic
cagtcatttgggtatggcactggtagaa

SEQ ID NO: 7535 - DNA, 28 bp, Artificial Sequence
  Synthetic
cagtcatttgggtggacggagaactgat

SEQ ID NO: 7536 - DNA, 28 bp, Artificial Sequence
  Synthetic
cagtcatttgggtggagagaaaggcagt

SEQ ID NO: 7537 - DNA, 28 bp, Artificial Sequence
  Synthetic
cagtcatttgggcaaagaattctccttt

SEQ ID NO: 7538 - DNA, 28 bp, Artificial Sequence
  Synthetic
cagtcatttgggtcgtgtcttgtgttgc

SEQ ID NO: 7539 - DNA, 28 bp, Artificial Sequence
  Synthetic
cagtcatttggggtgcctactgagctga

SEQ ID NO: 7540 - DNA, 28 bp, Artificial Sequence
  Synthetic
cagtcatttgggtgatatgtttgatata

SEQ ID NO: 7541 - DNA, 28 bp, Artificial Sequence
  Synthetic
cagtcatttgggcaacggaatcccaaaa

SEQ ID NO: 7542 - DNA, 28 bp, Artificial Sequence
  Synthetic
cagtcatttgggctgacctatgaattga

SEQ ID NO: 7543 - DNA, 28 bp, Artificial Sequence
  Synthetic
cagtcatttgggaactggcctacaaagt

SEQ ID NO: 7544 - DNA, 28 bp, Artificial Sequence
  Synthetic
cagtcatttgggtgtaacagcaactcca

SEQ ID NO: 7545 - DNA, 28 bp, Artificial Sequence
  Synthetic
cagtcatttgggtagcagcacagaaata

SEQ ID NO: 7546 - DNA, 28 bp, Artificial Sequence
  Synthetic
cagtcatttgggtaggtagtttcatgtt

SEQ ID NO: 7547 - DNA, 28 bp, Artificial Sequence
  Synthetic
cagtcatttgggtaggtagtttcctgtt

SEQ ID NO: 7548 - DNA, 28 bp, Artificial Sequence
  Synthetic
cagtcatttgggcccagtgttcagacta

SEQ ID NO: 7549 - DNA, 28 bp, Artificial Sequence
  Synthetic
cagtcatttgggtgtgcaaatctatgca

SEQ ID NO: 7550 - DNA, 28 bp, Artificial Sequence
  Synthetic
cagtcatttgggtgtgcaaatccatgca

SEQ ID NO: 7551 - DNA, 28 bp, Artificial Sequence
  Synthetic
cagtcatttgggtaacactgtctggtaa

SEQ ID NO: 7552 - DNA, 28 bp, Artificial Sequence
  Synthetic
cagtcatttgggtaatactgcctggtaa

SEQ ID NO: 7553 - DNA, 28 bp, Artificial Sequence
  Synthetic
cagtcatttgggtaatactgccgggtaa

SEQ ID NO: 7554 - DNA, 28 bp, Artificial Sequence
  Synthetic
cagtcatttggggtgaaatgtttaggac

SEQ ID NO: 7555 - DNA, 28 bp, Artificial Sequence
  Synthetic
cagtcatttgggttccctttgtcatcct

SEQ ID NO: 7556 - DNA, 28 bp, Artificial Sequence
  Synthetic
cagtcatttgggtccttcattccaccgg

SEQ ID NO: 7557 - DNA, 28 bp, Artificial Sequence
  Synthetic
cagtcatttgggtggaatgtaaggaagt

SEQ ID NO: 7558 - DNA, 28 bp, Artificial Sequence
  Synthetic
cagtcatttggggcttctcctggctctc

SEQ ID NO: 7559 - DNA, 28 bp, Artificial Sequence
  Synthetic
cagtcatttgggataagacgagcaaaaa

SEQ ID NO: 7560 - DNA, 28 bp, Artificial Sequence
  Synthetic
cagtcatttgggtaaagtgcttatagtg

SEQ ID NO: 7561 - DNA, 28 bp, Artificial Sequence
  Synthetic
cagtcatttgggactgcattacgagcac

SEQ ID NO: 7562 - DNA, 28 bp, Artificial Sequence
  Synthetic
cagtcatttgggcaaagtgctcatagtg

SEQ ID NO: 7563 - DNA, 28 bp, Artificial Sequence
  Synthetic
cagtcatttgggactgcagtgtgagcac

SEQ ID NO: 7564 - DNA, 28 bp, Artificial Sequence
  Synthetic
cagtcatttgggtagcttatcagactga

SEQ ID NO: 7565 - DNA, 28 bp, Artificial Sequence
  Synthetic
cagtcatttgggctgtgcgtgtgacagc

SEQ ID NO: 7566 - DNA, 28 bp, Artificial Sequence
  Synthetic
cagtcatttgggttccctttgtcatcct

SEQ ID NO: 7567 - DNA, 28 bp, Artificial Sequence
  Synthetic
cagtcatttgggtaacagtctccagtca

SEQ ID NO: 7568 - DNA, 28 bp, Artificial Sequence
  Synthetic
cagtcatttgggacagcaggcacagaca

SEQ ID NO: 7569 - DNA, 28 bp, Artificial Sequence
  Synthetic
cagtcatttgggatgacctatgatttga

SEQ ID NO: 7570 - DNA, 28 bp, Artificial Sequence
  Synthetic
cagtcatttgggtaatctcagctggcaa

SEQ ID NO: 7571 - DNA, 28 bp, Artificial Sequence
  Synthetic
cagtcatttgggtactgcatcaggaact

SEQ ID NO: 7572 - DNA, 28 bp, Artificial Sequence
  Synthetic
cagtcatttgggttgtgcttgatctaac

SEQ ID NO: 7573 - DNA, 28 bp, Artificial Sequence
  Synthetic
cagtcatttgggtgattgtccaaacgca

SEQ ID NO: 7574 - DNA, 28 bp, Artificial Sequence
  Synthetic
cagtcatttgggaagctgccagttgaag

SEQ ID NO: 7575 - DNA, 28 bp, Artificial Sequence
  Synthetic
cagtcatttgggagttcttcagtggcaa

SEQ ID NO: 7576 - DNA, 28 bp, Artificial Sequence
  Synthetic
cagtcatttgggagctacattgtctgct

SEQ ID NO: 7577 - DNA, 28 bp, Artificial Sequence
  Synthetic
cagtcatttgggagctacatctggctac

SEQ ID NO: 7578 - DNA, 28 bp, Artificial Sequence
  Synthetic
cagtcatttgggtgtcagtttgtcaaat

SEQ ID NO: 7579 - DNA, 28 bp, Artificial Sequence
  Synthetic
cagtcatttgggcaagtcactagtggtt

SEQ ID NO: 7580 - DNA, 28 bp, Artificial Sequence
  Synthetic
cagtcatttgggatcacattgccaggga

SEQ ID NO: 7581 - DNA, 28 bp, Artificial Sequence
  Synthetic
cagtcatttgggatcacattgccaggga

SEQ ID NO: 7582 - DNA, 28 bp, Artificial Sequence
  Synthetic
cagtcatttgggtggctcagttcagcag

SEQ ID NO: 7583 - DNA, 28 bp, Artificial Sequence
  Synthetic
cagtcatttgggcattgcacttgtctcg

SEQ ID NO: 7584 - DNA, 28 bp, Artificial Sequence
  Synthetic
cagtcatttgggttcaagtaatccagga

SEQ ID NO: 7585 - DNA, 28 bp, Artificial Sequence
  Synthetic
cagtcatttgggttcaagtaattcagga

SEQ ID NO: 7586 - DNA, 28 bp, Artificial Sequence
  Synthetic
cagtcatttgggttcacagtggctaagt

SEQ ID NO: 7587 - DNA, 28 bp, Artificial Sequence
  Synthetic
cagtcatttgggttcacagtggctaagt

SEQ ID NO: 7588 - DNA, 28 bp, Artificial Sequence
  Synthetic
cagtcatttgggaaggagctcacagtct

SEQ ID NO: 7589 - DNA, 28 bp, Artificial Sequence
  Synthetic
cagtcatttgggctcaaactatgggggc

SEQ ID NO: 7590 - DNA, 28 bp, Artificial Sequence
  Synthetic
cagtcatttgggaaagtgcttccacttt

SEQ ID NO: 7591 - DNA, 28 bp, Artificial Sequence
  Synthetic
cagtcatttgggcatcaaagtggaggcc

SEQ ID NO: 7592 - DNA, 28 bp, Artificial Sequence
  Synthetic
cagtcatttgggaagtgccgccaggttt

SEQ ID NO: 7593 - DNA, 28 bp, Artificial Sequence
  Synthetic
cagtcatttgggactcaaactgggggct

SEQ ID NO: 7594 - DNA, 28 bp, Artificial Sequence
  Synthetic
cagtcatttgggagggccccccctcaat

SEQ ID NO: 7595 - DNA, 28 bp, Artificial Sequence
  Synthetic
cagtcatttgggatgtatgtgtgcatgt

SEQ ID NO: 7596 - DNA, 28 bp, Artificial Sequence
  Synthetic
cagtcatttgggggcagaggagggctgt

SEQ ID NO: 7597 - DNA, 28 bp, Artificial Sequence
  Synthetic
cagtcatttgggtggtttaccgtcccac

SEQ ID NO: 7598 - DNA, 28 bp, Artificial Sequence
  Synthetic
cagtcatttgggtagcaccatctgaaat

SEQ ID NO: 7599 - DNA, 28 bp, Artificial Sequence
  Synthetic
cagtcatttgggtagcaccatttgaaat

SEQ ID NO: 7600 - DNA, 28 bp, Artificial Sequence
  Synthetic
cagtcatttgggtagcaccatttgaaat

SEQ ID NO: 7601 - DNA, 28 bp, Artificial Sequence
  Synthetic
cagtcatttgggtgaccgatttctcctg

SEQ ID NO: 7602 - DNA, 28 bp, Artificial Sequence
  Synthetic
cagtcatttgggtatgcaagggcaagct

SEQ ID NO: 7603 - DNA, 28 bp, Artificial Sequence
  Synthetic
cagtcatttgggcagtgcaatagtattg

SEQ ID NO: 7604 - DNA, 28 bp, Artificial Sequence
  Synthetic
cagtcatttgggctttcagtcggatgtt

SEQ ID NO: 7605 - DNA, 28 bp, Artificial Sequence
  Synthetic
cagtcatttgggtgtaaacatcctcgac

SEQ ID NO: 7606 - DNA, 28 bp, Artificial Sequence
  Synthetic
cagtcatttgggtgtaaacatcctacac

SEQ ID NO: 7607 - DNA, 28 bp, Artificial Sequence
  Synthetic
cagtcatttgggtgtaaacatcctacac

SEQ ID NO: 7608 - DNA, 28 bp, Artificial Sequence
  Synthetic
cagtcatttgggtgtaaacatccccgac

SEQ ID NO: 7609 - DNA, 28 bp, Artificial Sequence
  Synthetic
cagtcatttgggtgtaaacatccttgac

SEQ ID NO: 7610 - DNA, 28 bp, Artificial Sequence
  Synthetic
cagtcatttgggaggcaagatgctggca

SEQ ID NO: 7611 - DNA, 28 bp, Artificial Sequence
  Synthetic
cagtcatttgggtattgcacattactaa

SEQ ID NO: 7612 - DNA, 28 bp, Artificial Sequence
  Synthetic
cagtcatttgggaaaagctgggttgaga

SEQ ID NO: 7613 - DNA, 28 bp, Artificial Sequence
  Synthetic
cagtcatttgggaaacatgaagcgctgc

SEQ ID NO: 7614 - DNA, 28 bp, Artificial Sequence
  Synthetic
cagtcatttggggcacattacacggtcg

SEQ ID NO: 7615 - DNA, 28 bp, Artificial Sequence
  Synthetic
cagtcatttgggccactgccccaggtgc

SEQ ID NO: 7616 - DNA, 28 bp, Artificial Sequence
  Synthetic
cagtcatttgggcgcatcccctagggca

SEQ ID NO: 7617 - DNA, 28 bp, Artificial Sequence
  Synthetic
cagtcatttgggcctagtaggtgctcag

SEQ ID NO: 7618 - DNA, 28 bp, Artificial Sequence
  Synthetic
cagtcatttgggcctctgggcccttcct

SEQ ID NO: 7619 - DNA, 28 bp, Artificial Sequence
  Synthetic
cagtcatttgggccttgaggggcatgag

SEQ ID NO: 7620 - DNA, 28 bp, Artificial Sequence
  Synthetic
cagtcatttgggctggccctctctgccc

SEQ ID NO: 7621 - DNA, 28 bp, Artificial Sequence
  Synthetic
cagtcatttgggaacacacccagctaac

SEQ ID NO: 7622 - DNA, 28 bp, Artificial Sequence
  Synthetic
cagtcatttggggtgcattgtagttgca

SEQ ID NO: 7623 - DNA, 28 bp, Artificial Sequence
  Synthetic
cagtcatttggggcaaagcacagggcct

SEQ ID NO: 7624 - DNA, 28 bp, Artificial Sequence
  Synthetic
cagtcatttggggcccctgggcctatcc

SEQ ID NO: 7625 - DNA, 28 bp, Artificial Sequence
  Synthetic
cagtcatttggggtggtgtgctagttac

SEQ ID NO: 7626 - DNA, 28 bp, Artificial Sequence
  Synthetic
cagtcatttgggtcaagagcaataacga

SEQ ID NO: 7627 - DNA, 28 bp, Artificial Sequence
  Synthetic
cagtcatttgggtcacccttccatatct

SEQ ID NO: 7628 - DNA, 28 bp, Artificial Sequence
  Synthetic
cagtcatttgggttcagctcctatatga

SEQ ID NO: 7629 - DNA, 28 bp, Artificial Sequence
  Synthetic
cagtcatttgggtccagcatcagtgatt

SEQ ID NO: 7630 - DNA, 28 bp, Artificial Sequence
  Synthetic
cagtcatttgggtccctgtcctccagga

SEQ ID NO: 7631 - DNA, 28 bp, Artificial Sequence
  Synthetic
cagtcatttgggtccgtctcagttactt

SEQ ID NO: 7632 - DNA, 28 bp, Artificial Sequence
  Synthetic
cagtcatttgggtcgatcggtcggtcgg

SEQ ID NO: 7633 - DNA, 28 bp, Artificial Sequence
  Synthetic
cagtcatttgggtctcacacagaaatcg

SEQ ID NO: 7634 - DNA, 28 bp, Artificial Sequence
  Synthetic
cagtcatttgggtctccctccgtgtgcc

SEQ ID NO: 7635 - DNA, 28 bp, Artificial Sequence
  Synthetic
cagtcatttgggtgatctagccaaagcc

SEQ ID NO: 7636 - DNA, 28 bp, Artificial Sequence
  Synthetic
cagtcatttgggtgctgacccctagtcc

SEQ ID NO: 7637 - DNA, 28 bp, Artificial Sequence
  Synthetic
cagtcatttgggtgtctgcctgagtgcc

SEQ ID NO: 7638 - DNA, 28 bp, Artificial Sequence
  Synthetic
cagtcatttgggtgtccctctgggtcgc

SEQ ID NO: 7639 - DNA, 28 bp, Artificial Sequence
  Synthetic
cagtcatttgggcagccctgctgtctta

SEQ ID NO: 7640 - DNA, 28 bp, Artificial Sequence
  Synthetic
cagtcatttgggtggcagtgtcttagct

SEQ ID NO: 7641 - DNA, 28 bp, Artificial Sequence
  Synthetic
cagtcatttgggtaggcagtgtaattag

SEQ ID NO: 7642 - DNA, 28 bp, Artificial Sequence
  Synthetic
cagtcatttgggaggcagtgtagttagc

SEQ ID NO: 7643 - DNA, 28 bp, Artificial Sequence
  Synthetic
cagtcatttgggttcacaaagcccatac

SEQ ID NO: 7644 - DNA, 28 bp, Artificial Sequence
  Synthetic
cagtcatttgggtccctgaggagccctt

SEQ ID NO: 7645 - DNA, 28 bp, Artificial Sequence
  Synthetic
cagtcatttgggagagtagtaggttgca

SEQ ID NO: 7646 - DNA, 28 bp, Artificial Sequence
  Synthetic
cagtcatttgggttatcagaatctccag

SEQ ID NO: 7647 - DNA, 28 bp, Artificial Sequence
  Synthetic
cagtcatttgggaattgcacggtatcca

SEQ ID NO: 7648 - DNA, 28 bp, Artificial Sequence
  Synthetic
cagtcatttgggcgggtggatcacgatg

SEQ ID NO: 7649 - DNA, 28 bp, Artificial Sequence
  Synthetic
cagtcatttgggtaatgcccctaaaaat

SEQ ID NO: 7650 - DNA, 28 bp, Artificial Sequence
  Synthetic
cagtcatttgggaataatacatggttga

SEQ ID NO: 7651 - DNA, 28 bp, Artificial Sequence
  Synthetic
cagtcatttgggagatcgaccgtgttat

SEQ ID NO: 7652 - DNA, 28 bp, Artificial Sequence
  Synthetic
cagtcatttggggcctgctggggtggaa

SEQ ID NO: 7653 - DNA, 28 bp, Artificial Sequence
  Synthetic
cagtcatttgggatataatacaacctgc

SEQ ID NO: 7654 - DNA, 28 bp, Artificial Sequence
  Synthetic
cagtcatttgggatcgtagaggaaaatc

SEQ ID NO: 7655 - DNA, 28 bp, Artificial Sequence
  Synthetic
cagtcatttgggggtagattctccttct

SEQ ID NO: 7656 - DNA, 28 bp, Artificial Sequence
  Synthetic
cagtcatttgggatcatagaggaacatc

SEQ ID NO: 7657 - DNA, 28 bp, Artificial Sequence
  Synthetic
cagtcatttggggtggatattccttcta

SEQ ID NO: 7658 - DNA, 28 bp, Artificial Sequence
  Synthetic
cagtcatttgggaacatagaggaaattt

SEQ ID NO: 7659 - DNA, 28 bp, Artificial Sequence
  Synthetic
cagtcatttgggatcacacaaaggcaac

SEQ ID NO: 7660 - DNA, 28 bp, Artificial Sequence
  Synthetic
cagtcatttgggctcctgactccaggtc

SEQ ID NO: 7661 - DNA, 28 bp, Artificial Sequence
  Synthetic
cagtcatttgggtggtagactatggaac

SEQ ID NO: 7662 - DNA, 28 bp, Artificial Sequence
  Synthetic
cagtcatttgggtatacaagggcaagct

SEQ ID NO: 7663 - DNA, 28 bp, Artificial Sequence
  Synthetic
cagtcatttggggaagttgttcgtggtg

SEQ ID NO: 7664 - DNA, 28 bp, Artificial Sequence
  Synthetic
cagtcatttgggaatcattcacggacaa

SEQ ID NO: 7665 - DNA, 28 bp, Artificial Sequence
  Synthetic
cagtcatttgggagatcagaaggtgact

SEQ ID NO: 7666 - DNA, 28 bp, Artificial Sequence
  Synthetic
cagtcatttgggaatgttgctcggtgaa

SEQ ID NO: 7667 - DNA, 28 bp, Artificial Sequence
  Synthetic
cagtcatttgggaggttacccgagcaac

SEQ ID NO: 7668 - DNA, 28 bp, Artificial Sequence
  Synthetic
cagtcatttgggacttcacctggtccac

SEQ ID NO: 7669 - DNA, 28 bp, Artificial Sequence
  Synthetic
cagtcatttgggggcctcattaaatgtt

SEQ ID NO: 7670 - DNA, 28 bp, Artificial Sequence
  Synthetic
cagtcatttgggactggacttggagtca

SEQ ID NO: 7671 - DNA, 28 bp, Artificial Sequence
  Synthetic
cagtcatttgggcagcagcaattcatgt

SEQ ID NO: 7672 - DNA, 28 bp, Artificial Sequence
  Synthetic
cagtcatttgggtaatactgtctggtaa

SEQ ID NO: 7673 - DNA, 28 bp, Artificial Sequence
  Synthetic
cagtcatttgggtgtcttgcaggccgtc

SEQ ID NO: 7674 - DNA, 28 bp, Artificial Sequence
  Synthetic
cagtcatttgggatcatgatgggctcct

SEQ ID NO: 7675 - DNA, 28 bp, Artificial Sequence
  Synthetic
cagtcatttgggttgcatatgtaggatg

SEQ ID NO: 7676 - DNA, 28 bp, Artificial Sequence
  Synthetic
cagtcatttgggtggcagtgtattgtta

SEQ ID NO: 7677 - DNA, 28 bp, Artificial Sequence
  Synthetic
cagtcatttgggtttttgcgatgtgttc

SEQ ID NO: 7678 - DNA, 28 bp, Artificial Sequence
  Synthetic
cagtcatttgggaaaccgttaccattac

SEQ ID NO: 7679 - DNA, 28 bp, Artificial Sequence
  Synthetic
cagtcatttgggtcactcctcccctccc

SEQ ID NO: 7680 - DNA, 28 bp, Artificial Sequence
  Synthetic
cagtcatttgggagaggctggccgtgat

SEQ ID NO: 7681 - DNA, 28 bp, Artificial Sequence
  Synthetic
cagtcatttgggaatcgtacagggtcat

SEQ ID NO: 7682 - DNA, 28 bp, Artificial Sequence
  Synthetic
cagtcatttgggaatgacatcacatata

SEQ ID NO: 7683 - DNA, 28 bp, Artificial Sequence
  Synthetic
cagtcatttgggtgaaggtctactgtgt

SEQ ID NO: 7684 - DNA, 28 bp, Artificial Sequence
  Synthetic
cagtcatttgggtgaaacatacacggga

SEQ ID NO: 7685 - DNA, 28 bp, Artificial Sequence
  Synthetic
cagtcatttgggcagcagcacactgtgg

SEQ ID NO: 7686 - DNA, 28 bp, Artificial Sequence
  Synthetic
cagtcatttgggttaagacttgcagtga

SEQ ID NO: 7687 - DNA, 28 bp, Artificial Sequence
  Synthetic
cagtcatttgggaatcctttgtccctgg

SEQ ID NO: 7688 - DNA, 28 bp, Artificial Sequence
  Synthetic
cagtcatttgggtagcagcgggaacagt

SEQ ID NO: 7689 - DNA, 28 bp, Artificial Sequence
  Synthetic
cagtcatttggggtcaacacttgctggt

SEQ ID NO: 7690 - DNA, 28 bp, Artificial Sequence
  Synthetic
cagtcatttgggggagaaattatccttg

SEQ ID NO: 7691 - DNA, 28 bp, Artificial Sequence
  Synthetic
cagtcatttgggaggtcagaggtcgatc

SEQ ID NO: 7692 - DNA, 28 bp, Artificial Sequence
  Synthetic
cagtcatttgggaagggattctgatgtt

SEQ ID NO: 7693 - DNA, 28 bp, Artificial Sequence
  Synthetic
cagtcatttgggtgtgacagattgataa

SEQ ID NO: 7694 - DNA, 28 bp, Artificial Sequence
  Synthetic
cagtcatttgggctcggggatcatcatg

SEQ ID NO: 7695 - DNA, 28 bp, Artificial Sequence
  Synthetic
cagtcatttgggaaacattcgcggtgca

SEQ ID NO: 7696 - DNA, 28 bp, Artificial Sequence
  Synthetic
cagtcatttgggtattcatttactcccc

SEQ ID NO: 7697 - DNA, 28 bp, Artificial Sequence
  Synthetic
cagtcatttgggtggaagactagtgatt

SEQ ID NO: 7698 - DNA, 28 bp, Artificial Sequence
  Synthetic
cagtcatttgggcaacaaatcacagtct

SEQ ID NO: 7699 - DNA, 28 bp, Artificial Sequence
  Synthetic
cagtcatttgggtggaagacttgtgatt

SEQ ID NO: 7700 - DNA, 28 bp, Artificial Sequence
  Synthetic
cagtcatttgggtctttggttatctagc

SEQ ID NO: 7701 - DNA, 28 bp, Artificial Sequence
  Synthetic
cagtcatttgggtattgcacttgtcccg

SEQ ID NO: 7702 - DNA, 28 bp, Artificial Sequence
  Synthetic
cagtcatttgggcaaagtgctgttcgtg

SEQ ID NO: 7703 - DNA, 28 bp, Artificial Sequence
  Synthetic
cagtcatttgggtttggcactagcacat

SEQ ID NO: 7704 - DNA, 28 bp, Artificial Sequence
  Synthetic
cagtcatttgggtgaggtagtaagttgt

SEQ ID NO: 7705 - DNA, 28 bp, Artificial Sequence
  Synthetic
cagtcatttgggaacccgtagatccgat

SEQ ID NO: 7706 - DNA, 28 bp, Artificial Sequence
  Synthetic
cagtcatttgggcacccgtagaaccgac

SEQ ID NO: 7707 - DNA, 28 bp, Artificial Sequence
  Synthetic
cagtcatttgggtgacagaagagagtga

SEQ ID NO: 7708 - DNA, 28 bp, Artificial Sequence
  Synthetic
cagtcatttgggtgacagaagagagtga

SEQ ID NO: 7709 - DNA, 28 bp, Artificial Sequence
  Synthetic
cagtcatttgggtgacagaagagagtga

SEQ ID NO: 7710 - DNA, 28 bp, Artificial Sequence
  Synthetic
cagtcatttgggtgacagaagagagaga

SEQ ID NO: 7711 - DNA, 28 bp, Artificial Sequence
  Synthetic
cagtcatttgggtgacagaagagagcga

SEQ ID NO: 7712 - DNA, 28 bp, Artificial Sequence
  Synthetic
cagtcatttgggtttggattgaagggag

SEQ ID NO: 7713 - DNA, 28 bp, Artificial Sequence
  Synthetic
cagtcatttgggcttggattgaagggag

SEQ ID NO: 7714 - DNA, 28 bp, Artificial Sequence
  Synthetic
cagtcatttgggtgcctggctccctgta

SEQ ID NO: 7715 - DNA, 28 bp, Artificial Sequence
  Synthetic
cagtcatttgggtgcctggctccctgta

SEQ ID NO: 7716 - DNA, 28 bp, Artificial Sequence
  Synthetic
cagtcatttgggtgcctggctccctgta

SEQ ID NO: 7717 - DNA, 28 bp, Artificial Sequence
  Synthetic
cagtcatttgggtgcctggctccctgta

SEQ ID NO: 7718 - DNA, 28 bp, Artificial Sequence
  Synthetic
cagtcatttgggtgcctggctccctgta

SEQ ID NO: 7719 - DNA, 28 bp, Artificial Sequence
  Synthetic
cagtcatttgggtggagaagcagggcac

SEQ ID NO: 7720 - DNA, 28 bp, Artificial Sequence
  Synthetic
cagtcatttgggtggagaagcagggcac

SEQ ID NO: 7721 - DNA, 28 bp, Artificial Sequence
  Synthetic
cagtcatttgggtggagaagcaggacac

SEQ ID NO: 7722 - DNA, 28 bp, Artificial Sequence
  Synthetic
cagtcatttgggtcggaccaggcttcat

SEQ ID NO: 7723 - DNA, 28 bp, Artificial Sequence
  Synthetic
cagtcatttgggtcggaccaggcttcat

SEQ ID NO: 7724 - DNA, 28 bp, Artificial Sequence
  Synthetic
cagtcatttgggtcggaccaggcttcat

SEQ ID NO: 7725 - DNA, 28 bp, Artificial Sequence
  Synthetic
cagtcatttgggtcggaccaggcttcat

SEQ ID NO: 7726 - DNA, 28 bp, Artificial Sequence
  Synthetic
cagtcatttgggtcggaccaggcttcaa

SEQ ID NO: 7727 - DNA, 28 bp, Artificial Sequence
  Synthetic
cagtcatttgggtcggaccaggcttcat

SEQ ID NO: 7728 - DNA, 28 bp, Artificial Sequence
  Synthetic
cagtcatttgggtcggaccaggcttcaa

SEQ ID NO: 7729 - DNA, 28 bp, Artificial Sequence
  Synthetic
cagtcatttgggtgaagctgccagcatg

SEQ ID NO: 7730 - DNA, 28 bp, Artificial Sequence
  Synthetic
cagtcatttgggtgaagctgccagcatg

SEQ ID NO: 7731 - DNA, 28 bp, Artificial Sequence
  Synthetic
cagtcatttgggtgaagctgccagcatg

SEQ ID NO: 7732 - DNA, 28 bp, Artificial Sequence
  Synthetic
cagtcatttgggtgaagctgccagcatg

SEQ ID NO: 7733 - DNA, 28 bp, Artificial Sequence
  Synthetic
cagtcatttgggtgaagctgccagcatg

SEQ ID NO: 7734 - DNA, 28 bp, Artificial Sequence
  Synthetic
cagtcatttgggtgaagctgccagcatg

SEQ ID NO: 7735 - DNA, 28 bp, Artificial Sequence
  Synthetic
cagtcatttgggtgaagctgccagcatg

SEQ ID NO: 7736 - DNA, 28 bp, Artificial Sequence
  Synthetic
cagtcatttgggtcgcttggtgcagatc

SEQ ID NO: 7737 - DNA, 28 bp, Artificial Sequence
  Synthetic
cagtcatttgggcagccaaggatgactt

SEQ ID NO: 7738 - DNA, 28 bp, Artificial Sequence
  Synthetic
cagtcatttgggcagccaaggatgactt

SEQ ID NO: 7739 - DNA, 28 bp, Artificial Sequence
  Synthetic
cagtcatttgggtagccaaggatgactt

SEQ ID NO: 7740 - DNA, 28 bp, Artificial Sequence
  Synthetic
cagtcatttgggtagccaaggatgactt

SEQ ID NO: 7741 - DNA, 28 bp, Artificial Sequence
  Synthetic
cagtcatttgggtagccaaggatgactt

SEQ ID NO: 7742 - DNA, 28 bp, Artificial Sequence
  Synthetic
cagtcatttgggtagccaaggatgactt

SEQ ID NO: 7743 - DNA, 28 bp, Artificial Sequence
  Synthetic
cagtcatttgggtagccaaggatgactt

SEQ ID NO: 7744 - DNA, 28 bp, Artificial Sequence
  Synthetic
cagtcatttgggtagccaaggatgactt

SEQ ID NO: 7745 - DNA, 28 bp, Artificial Sequence
  Synthetic
cagtcatttgggtagccaagaatgactt

SEQ ID NO: 7746 - DNA, 28 bp, Artificial Sequence
  Synthetic
cagtcatttgggtgattgagccgtgcca

SEQ ID NO: 7747 - DNA, 28 bp, Artificial Sequence
  Synthetic
cagtcatttgggtgattgagccgtgcca

SEQ ID NO: 7748 - DNA, 28 bp, Artificial Sequence
  Synthetic
cagtcatttggggaggtgagccgagcca

SEQ ID NO: 7749 - DNA, 28 bp, Artificial Sequence
  Synthetic
cagtcatttgggtgattgagccgtgcca

SEQ ID NO: 7750 - DNA, 28 bp, Artificial Sequence
  Synthetic
cagtcatttggggtgagccgaaccaata

SEQ ID NO: 7751 - DNA, 28 bp, Artificial Sequence
  Synthetic
cagtcatttgggatgagccgaaccaata

SEQ ID NO: 7752 - DNA, 28 bp, Artificial Sequence
  Synthetic
cagtcatttgggagaatcttgatgatgc

SEQ ID NO: 7753 - DNA, 28 bp, Artificial Sequence
  Synthetic
cagtcatttgggggaatcttgatgatgc

SEQ ID NO: 7754 - DNA, 28 bp, Artificial Sequence
  Synthetic
cagtcatttgggagaatcttgatgatgc

SEQ ID NO: 7755 - DNA, 28 bp, Artificial Sequence
  Synthetic
cagtcatttgggagaatcttgatgatgc

SEQ ID NO: 7756 - DNA, 28 bp, Artificial Sequence
  Synthetic
cagtcatttgggtgaatcttgatgatgc

SEQ ID NO: 7757 - DNA, 28 bp, Artificial Sequence
  Synthetic
cagtcatttgggttggactgaagggtgc

SEQ ID NO: 7758 - DNA, 28 bp, Artificial Sequence
  Synthetic
cagtcatttgggtccaaagggatcgcat

SEQ ID NO: 7759 - DNA, 28 bp, Artificial Sequence
  Synthetic
cagtcatttgggttggcattctgtccac

SEQ ID NO: 7760 - DNA, 28 bp, Artificial Sequence
  Synthetic
cagtcatttgggttggcattctgtccac

SEQ ID NO: 7761 - DNA, 28 bp, Artificial Sequence
  Synthetic
cagtcatttggggtgaagtgtttggggg

SEQ ID NO: 7762 - DNA, 28 bp, Artificial Sequence
  Synthetic
cagtcatttggggtgaagtgtttggggg

SEQ ID NO: 7763 - DNA, 28 bp, Artificial Sequence
  Synthetic
cagtcatttggggtgaagtgtttggggg

SEQ ID NO: 7764 - DNA, 28 bp, Artificial Sequence
  Synthetic
cagtcatttggggtgaagtgtttggggg

SEQ ID NO: 7765 - DNA, 28 bp, Artificial Sequence
  Synthetic
cagtcatttggggtgaagtgtttggggg

SEQ ID NO: 7766 - DNA, 28 bp, Artificial Sequence
  Synthetic
cagtcatttgggatgaagtgtttggggg

SEQ ID NO: 7767 - DNA, 28 bp, Artificial Sequence
  Synthetic
cagtcatttgggttccacagctttcttg

SEQ ID NO: 7768 - DNA, 28 bp, Artificial Sequence
  Synthetic
cagtcatttgggttccacagctttcttg

SEQ ID NO: 7769 - DNA, 28 bp, Artificial Sequence
  Synthetic
cagtcatttgggttccacagctttcttg

SEQ ID NO: 7770 - DNA, 28 bp, Artificial Sequence
  Synthetic
cagtcatttgggtgccaaaggagaattg

SEQ ID NO: 7771 - DNA, 28 bp, Artificial Sequence
  Synthetic
cagtcatttgggtgccaaaggagagctg

SEQ ID NO: 7772 - DNA, 28 bp, Artificial Sequence
  Synthetic
cagtcatttgggtgccaaaggagaattg

SEQ ID NO: 7773 - DNA, 28 bp, Artificial Sequence
  Synthetic
cagtcatttgggtgccaaaggagagttg

SEQ ID NO: 7774 - DNA, 28 bp, Artificial Sequence
  Synthetic
cagtcatttgggtgccaaaggagatttg

SEQ ID NO: 7775 - DNA, 28 bp, Artificial Sequence
  Synthetic
cagtcatttgggtgccaaaggagatttg

SEQ ID NO: 7776 - DNA, 28 bp, Artificial Sequence
  Synthetic
cagtcatttgggtgccaaaggaaatttg

SEQ ID NO: 7777 - DNA, 28 bp, Artificial Sequence
  Synthetic
cagtcatttgggtgccaaaggagaattg

SEQ ID NO: 7778 - DNA, 28 bp, Artificial Sequence
  Synthetic
cagtcatttgggtgccaaaggagagttg

SEQ ID NO: 7779 - DNA, 28 bp, Artificial Sequence
  Synthetic
cagtcatttgggaacccgtagatccgaa

SEQ ID NO: 7780 - DNA, 28 bp, Artificial Sequence
  Synthetic
cagtcatttgggtacagtactgtgataa

SEQ ID NO: 7781 - DNA, 28 bp, Artificial Sequence
  Synthetic
cagtcatttgggtcaaatgctcagactc

SEQ ID NO: 7782 - DNA, 28 bp, Artificial Sequence
  Synthetic
cagtcatttgggaaaagtgcttacagtg

SEQ ID NO: 7783 - DNA, 28 bp, Artificial Sequence
  Synthetic
cagtcatttgggtaaagtgctgacagtg

SEQ ID NO: 7784 - DNA, 28 bp, Artificial Sequence
  Synthetic
cagtcatttgggtaccctgtagatccga

SEQ ID NO: 7785 - DNA, 28 bp, Artificial Sequence
  Synthetic
cagtcatttgggtccctgagaccctaac

SEQ ID NO: 7786 - DNA, 28 bp, Artificial Sequence
  Synthetic
cagtcatttgggtcggatccgtctgagc

SEQ ID NO: 7787 - DNA, 28 bp, Artificial Sequence
  Synthetic
cagtcatttgggtcacagtgaaccggtc

SEQ ID NO: 7788 - DNA, 28 bp, Artificial Sequence
  Synthetic
cagtcatttgggttggtccccttcaacc

SEQ ID NO: 7789 - DNA, 28 bp, Artificial Sequence
  Synthetic
cagtcatttggggtgtgtggaaatgctt

SEQ ID NO: 7790 - DNA, 28 bp, Artificial Sequence
  Synthetic
cagtcatttgggtagcagcacataatgg

SEQ ID NO: 7791 - DNA, 28 bp, Artificial Sequence
  Synthetic
cagtcatttgggtagcagcacgtaaata

SEQ ID NO: 7792 - DNA, 28 bp, Artificial Sequence
  Synthetic
cagtcatttgggactgcagtgaaggcac

SEQ ID NO: 7793 - DNA, 28 bp, Artificial Sequence
  Synthetic
cagtcatttgggcaaagtgcttacagtg

SEQ ID NO: 7794 - DNA, 28 bp, Artificial Sequence
  Synthetic
cagtcatttgggtaaggtgcatctagtg

SEQ ID NO: 7795 - DNA, 28 bp, Artificial Sequence
  Synthetic
cagtcatttgggaacattcaacgctgtc

SEQ ID NO: 7796 - DNA, 28 bp, Artificial Sequence
  Synthetic
cagtcatttgggtatggcactggtagaa

SEQ ID NO: 7797 - DNA, 28 bp, Artificial Sequence
  Synthetic
cagtcatttgggggtccagaggggagct

SEQ ID NO: 7798 - DNA, 28 bp, Artificial Sequence
  Synthetic
cagtcatttgggcccagtgttcagacta

SEQ ID NO: 7799 - DNA, 28 bp, Artificial Sequence
  Synthetic
cagtcatttgggtgtgcaaatctatgca

SEQ ID NO: 7800 - DNA, 28 bp, Artificial Sequence
  Synthetic
cagtcatttgggtgtgcaaatccatgca

SEQ ID NO: 7801 - DNA, 28 bp, Artificial Sequence
  Synthetic
cagtcatttgggtaaagtgcttatagtg

SEQ ID NO: 7802 - DNA, 28 bp, Artificial Sequence
  Synthetic
cagtcatttgggttccctttgtcatcct

SEQ ID NO: 7803 - DNA, 28 bp, Artificial Sequence
  Synthetic
cagtcatttgggacagcaggcacagaca

SEQ ID NO: 7804 - DNA, 28 bp, Artificial Sequence
  Synthetic
cagtcatttgggttgtgcttgatctaac

SEQ ID NO: 7805 - DNA, 28 bp, Artificial Sequence
  Synthetic
cagtcatttgggaagctgccagttgaag

SEQ ID NO: 7806 - DNA, 28 bp, Artificial Sequence
  Synthetic
cagtcatttgggtgtcagtttgtcaaat

SEQ ID NO: 7807 - DNA, 28 bp, Artificial Sequence
  Synthetic
cagtcatttgggatcacattgccaggga

SEQ ID NO: 7808 - DNA, 28 bp, Artificial Sequence
  Synthetic
cagtcatttgggttcacagtggctaagt

SEQ ID NO: 7809 - DNA, 28 bp, Artificial Sequence
  Synthetic
cagtcatttgggaaggagctcacagtct

SEQ ID NO: 7810 - DNA, 28 bp, Artificial Sequence
  Synthetic
cagtcatttgggctagcaccatctgaaa

SEQ ID NO: 7811 - DNA, 28 bp, Artificial Sequence
  Synthetic
cagtcatttgggtagcaccatttgaaat

SEQ ID NO: 7812 - DNA, 28 bp, Artificial Sequence
  Synthetic
cagtcatttgggtattgcacattactaa

SEQ ID NO: 7813 - DNA, 28 bp, Artificial Sequence
  Synthetic
cagtcatttgggtggcagtgtcttagct

SEQ ID NO: 7814 - DNA, 28 bp, Artificial Sequence
  Synthetic
cagtcatttgggtggaagactagtgatt

SEQ ID NO: 7815 - DNA, 28 bp, Artificial Sequence
  Synthetic
cagtcatttgggtattgcacttgtcccg

SEQ ID NO: 7816 - DNA, 28 bp, Artificial Sequence
  Synthetic
cagtcatttgggaaagtgctgttcgtgc

SEQ ID NO: 7817 - DNA, 28 bp, Artificial Sequence
  Synthetic
cagtcatttgggttcaacgggtatttat

SEQ ID NO: 7818 - DNA, 28 bp, Artificial Sequence
  Synthetic
cagtcatttgggtttggcactagcacat

SEQ ID NO: 7819 - DNA, 28 bp, Artificial Sequence
  Synthetic
cagtcatttgggtgagatcactatgaaa

SEQ ID NO: 7820 - DNA, 28 bp, Artificial Sequence
  Synthetic
cagtcatttgggtgagatcactgcgaaa

SEQ ID NO: 7821 - DNA, 28 bp, Artificial Sequence
  Synthetic
cagtcatttgggtgagatcattatgaaa

SEQ ID NO: 7822 - DNA, 28 bp, Artificial Sequence
  Synthetic
cagtcatttgggtgaggtagaatgttgg

SEQ ID NO: 7823 - DNA, 28 bp, Artificial Sequence
  Synthetic
cagtcatttgggtgaggtagattgttgg

SEQ ID NO: 7824 - DNA, 28 bp, Artificial Sequence
  Synthetic
cagtcatttgggccattcaactatctgt

SEQ ID NO: 7825 - DNA, 28 bp, Artificial Sequence
  Synthetic
cagtcatttgggtgaggtagtgactcaa

SEQ ID NO: 7826 - DNA, 28 bp, Artificial Sequence
  Synthetic
cagtcatttgggtccctgagaccttcga

SEQ ID NO: 7827 - DNA, 28 bp, Artificial Sequence
  Synthetic
cagtcatttgggaaccctgtagatccga

SEQ ID NO: 7828 - DNA, 28 bp, Artificial Sequence
  Synthetic
cagtcatttgggtcgaatcttcaaggtg

SEQ ID NO: 7829 - DNA, 28 bp, Artificial Sequence
  Synthetic
cagtcatttgggtgagtattctatcagg

SEQ ID NO: 7830 - DNA, 28 bp, Artificial Sequence
  Synthetic
cagtcatttgggtaaggcacgcggtgaa

SEQ ID NO: 7831 - DNA, 28 bp, Artificial Sequence
  Synthetic
cagtcatttgggtaaggcacgcggtgaa

SEQ ID NO: 7832 - DNA, 28 bp, Artificial Sequence
  Synthetic
cagtcatttgggtaaggcacgcggtgaa

SEQ ID NO: 7833 - DNA, 28 bp, Artificial Sequence
  Synthetic
cagtcatttggggcgctcacctcgtgac

SEQ ID NO: 7834 - DNA, 28 bp, Artificial Sequence
  Synthetic
cagtcatttgggtccctgagaccattga

SEQ ID NO: 7835 - DNA, 28 bp, Artificial Sequence
  Synthetic
cagtcatttggggtagtttttggtatca

SEQ ID NO: 7836 - DNA, 28 bp, Artificial Sequence
  Synthetic
cagtcatttgggtccctgagatcataat

SEQ ID NO: 7837 - DNA, 28 bp, Artificial Sequence
  Synthetic
cagtcatttgggtatcacagtcatgcta

SEQ ID NO: 7838 - DNA, 28 bp, Artificial Sequence
  Synthetic
cagtcatttgggttggtccccatcaacc

SEQ ID NO: 7839 - DNA, 28 bp, Artificial Sequence
  Synthetic
cagtcatttggggacggaggtttgctaa

SEQ ID NO: 7840 - DNA, 28 bp, Artificial Sequence
  Synthetic
cagtcatttgggagatatgtttggttaa

SEQ ID NO: 7841 - DNA, 28 bp, Artificial Sequence
  Synthetic
cagtcatttgggaccactgaccgagcat

SEQ ID NO: 7842 - DNA, 28 bp, Artificial Sequence
  Synthetic
cagtcatttgggtgatatgtttggttta

SEQ ID NO: 7843 - DNA, 28 bp, Artificial Sequence
  Synthetic
cagtcatttgggaccattagcctaatgt

SEQ ID NO: 7844 - DNA, 28 bp, Artificial Sequence
  Synthetic
cagtcatttgggtggaatgtcgagaaat

SEQ ID NO: 7845 - DNA, 28 bp, Artificial Sequence
  Synthetic
cagtcatttgggtggaatgtcgtgaatt

SEQ ID NO: 7846 - DNA, 28 bp, Artificial Sequence
  Synthetic
cagtcatttgggtggaatgttgtgaata

SEQ ID NO: 7847 - DNA, 28 bp, Artificial Sequence
  Synthetic
cagtcatttgggtgattgtccatacgca

SEQ ID NO: 7848 - DNA, 28 bp, Artificial Sequence
  Synthetic
cagtcatttgggtaaatgcactatcgga

SEQ ID NO: 7849 - DNA, 28 bp, Artificial Sequence
  Synthetic
cagtcatttgggaaaatgcattatctgg

SEQ ID NO: 7850 - DNA, 28 bp, Artificial Sequence
  Synthetic
cagtcatttgggttgatcagaaatgcag

SEQ ID NO: 7851 - DNA, 28 bp, Artificial Sequence
  Synthetic
cagtcatttgggtaaatgcattatctgg

SEQ ID NO: 7852 - DNA, 28 bp, Artificial Sequence
  Synthetic
cagtcatttgggtaaatgcatttatctg

SEQ ID NO: 7853 - DNA, 28 bp, Artificial Sequence
  Synthetic
cagtcatttgggtcggtgggagtaacat

SEQ ID NO: 7854 - DNA, 28 bp, Artificial Sequence
  Synthetic
cagtcatttgggtgtcatggatatgctc

SEQ ID NO: 7855 - DNA, 28 bp, Artificial Sequence
  Synthetic
cagtcatttgggtgaagagctattcatg

SEQ ID NO: 7856 - DNA, 28 bp, Artificial Sequence
  Synthetic
cagtcatttgggtatcacagccccgctt

SEQ ID NO: 7857 - DNA, 28 bp, Artificial Sequence
  Synthetic
cagtcatttggggttctacggtgttgtg

SEQ ID NO: 7858 - DNA, 28 bp, Artificial Sequence
  Synthetic
cagtcatttgggtcacagccaattttga

SEQ ID NO: 7859 - DNA, 28 bp, Artificial Sequence
  Synthetic
cagtcatttgggtcatcattgttggttg

SEQ ID NO: 7860 - DNA, 28 bp, Artificial Sequence
  Synthetic
cagtcatttgggtcacagccaaaactga

SEQ ID NO: 7861 - DNA, 28 bp, Artificial Sequence
  Synthetic
cagtcatttgggtcacagccaaatttga

SEQ ID NO: 7862 - DNA, 28 bp, Artificial Sequence
  Synthetic
cagtcatttgggaggcaagatgttggca

SEQ ID NO: 7863 - DNA, 28 bp, Artificial Sequence
  Synthetic
cagtcatttgggaggcaagatgctggca

SEQ ID NO: 7864 - DNA, 28 bp, Artificial Sequence
  Synthetic
cagtcatttgggtcaccgggtagacatt

SEQ ID NO: 7865 - DNA, 28 bp, Artificial Sequence
  Synthetic
cagtcatttgggtgatgcatgctacttg

SEQ ID NO: 7866 - DNA, 28 bp, Artificial Sequence
  Synthetic
cagtcatttgggtgactagaaagttcac

SEQ ID NO: 7867 - DNA, 28 bp, Artificial Sequence
  Synthetic
cagtcatttgggtcacaacctccatgaa

SEQ ID NO: 7868 - DNA, 28 bp, Artificial Sequence
  Synthetic
cagtcatttgggtgaaagacacgggtag

SEQ ID NO: 7869 - DNA, 28 bp, Artificial Sequence
  Synthetic
cagtcatttgggtgaaagacacaggtag

SEQ ID NO: 7870 - DNA, 28 bp, Artificial Sequence
  Synthetic
cagtcatttgggtccttctaatgtgttt

SEQ ID NO: 7871 - DNA, 28 bp, Artificial Sequence
  Synthetic
cagtcatttgggtgaaagacatgggtag

SEQ ID NO: 7872 - DNA, 28 bp, Artificial Sequence
  Synthetic
cagtcatttgggtgctgcctggttaaga

SEQ ID NO: 7873 - DNA, 28 bp, Artificial Sequence
  Synthetic
cagtcatttgggtagcaccagggtatat

SEQ ID NO: 7874 - DNA, 28 bp, Artificial Sequence
  Synthetic
cagtcatttgggtaatctcatctggtaa

SEQ ID NO: 7875 - DNA, 28 bp, Artificial Sequence
  Synthetic
cagtcatttgggtggacggaagtgtaat

SEQ ID NO: 7876 - DNA, 28 bp, Artificial Sequence
  Synthetic
cagtcatttggggctgggatgagcctcg

SEQ ID NO: 7877 - DNA, 28 bp, Artificial Sequence
  Synthetic
cagtcatttgggtcagatctaactcttc

SEQ ID NO: 7878 - DNA, 28 bp, Artificial Sequence
  Synthetic
cagtcatttgggcatgtttgaatggcca

SEQ ID NO: 7879 - DNA, 28 bp, Artificial Sequence
  Synthetic
cagtcatttgggagtcagcattggtggt

SEQ ID NO: 7880 - DNA, 28 bp, Artificial Sequence
  Synthetic
cagtcatttggggagcttggattgtgat

SEQ ID NO: 7881 - DNA, 28 bp, Artificial Sequence
  Synthetic
cagtcatttggggttgcttggggttatt

SEQ ID NO: 7882 - DNA, 28 bp, Artificial Sequence
  Synthetic
cagtcatttgggtggagctattgtattt

SEQ ID NO: 7883 - DNA, 28 bp, Artificial Sequence
  Synthetic
cagtcatttgggcgatatgtggtaattt

SEQ ID NO: 7884 - DNA, 28 bp, Artificial Sequence
  Synthetic
cagtcatttggggtaaagctaaattacc

SEQ ID NO: 7885 - DNA, 28 bp, Artificial Sequence
  Synthetic
cagtcatttgggtggaagactattgatt

SEQ ID NO: 7886 - DNA, 28 bp, Artificial Sequence
  Synthetic
cagtcatttgggtggaagactgtcgatt

SEQ ID NO: 7887 - DNA, 28 bp, Artificial Sequence
  Synthetic
cagtcatttgggtggaagactgatgatt

SEQ ID NO: 7888 - DNA, 28 bp, Artificial Sequence
  Synthetic
cagtcatttgggtaatactgtcaggtaa

SEQ ID NO: 7889 - DNA, 28 bp, Artificial Sequence
  Synthetic
cagtcatttgggtgagcaaagtttcaag

SEQ ID NO: 7890 - DNA, 28 bp, Artificial Sequence
  Synthetic
cagtcatttggggtgagcaaagcttcaa

SEQ ID NO: 7891 - DNA, 28 bp, Artificial Sequence
  Synthetic
cagtcatttggggattgcactagttaat

SEQ ID NO: 7892 - DNA, 28 bp, Artificial Sequence
  Synthetic
cagtcatttgggtgacagaagagagtga

SEQ ID NO: 7893 - DNA, 28 bp, Artificial Sequence
  Synthetic
cagtcatttgggtttggattgaagggag

SEQ ID NO: 7894 - DNA, 28 bp, Artificial Sequence
  Synthetic
cagtcatttgggtttggattgaagggag

SEQ ID NO: 7895 - DNA, 28 bp, Artificial Sequence
  Synthetic
cagtcatttgggcttggattgaagggag

SEQ ID NO: 7896 - DNA, 28 bp, Artificial Sequence
  Synthetic
cagtcatttgggtttggattgaagggag

SEQ ID NO: 7897 - DNA, 28 bp, Artificial Sequence
  Synthetic
cagtcatttgggtttggattgaaaggag

SEQ ID NO: 7898 - DNA, 28 bp, Artificial Sequence
  Synthetic
cagtcatttgggtgaagctgccagcatg

SEQ ID NO: 7899 - DNA, 28 bp, Artificial Sequence
  Synthetic
cagtcatttgggtgaagctgccagcatg

SEQ ID NO: 7900 - DNA, 28 bp, Artificial Sequence
  Synthetic
cagtcatttgggtcgcttggtgcagatc

SEQ ID NO: 7901 - DNA, 28 bp, Artificial Sequence
  Synthetic
cagtcatttgggtcgcttgggcagatcg

SEQ ID NO: 7902 - DNA, 28 bp, Artificial Sequence
  Synthetic
cagtcatttgggttccacagctttcttg

SEQ ID NO: 7903 - DNA, 28 bp, Artificial Sequence
  Synthetic
cagtcatttgggctgcactgcctcttcc

SEQ ID NO: 7904 - DNA, 28 bp, Artificial Sequence
  Synthetic
cagtcatttgggctgcactgcctcttcc

SEQ ID NO: 7905 - DNA, 28 bp, Artificial Sequence
  Synthetic
cagtcatttgggctgcactgcctcttcc

SEQ ID NO: 7906 - DNA, 28 bp, Artificial Sequence
  Synthetic
cagtcatttgggctgcactgcctcttcc

SEQ ID NO: 7907 - DNA, 28 bp, Artificial Sequence
  Synthetic
cagtcatttgggctgcactgactcttcc

SEQ ID NO: 7908 - DNA, 28 bp, Artificial Sequence
  Synthetic
cagtcatttgggtgaggtagtaggttgt

SEQ ID NO: 7909 - DNA, 28 bp, Artificial Sequence
  Synthetic
cagtcatttgggtgaggtagtagattgt

SEQ ID NO: 7910 - DNA, 28 bp, Artificial Sequence
  Synthetic
cagtcatttgggtgaggtagtagtttgt

SEQ ID NO: 7911 - DNA, 28 bp, Artificial Sequence
  Synthetic
cagtcatttgggagcagcattgtacagg

SEQ ID NO: 7912 - DNA, 28 bp, Artificial Sequence
  Synthetic
cagtcatttgggtcaaatgctcagactc

SEQ ID NO: 7913 - DNA, 28 bp, Artificial Sequence
  Synthetic
cagtcatttgggtcaaatgctcagactc

SEQ ID NO: 7914 - DNA, 28 bp, Artificial Sequence
  Synthetic
cagtcatttgggaaaagtgcttacagtg

SEQ ID NO: 7915 - DNA, 28 bp, Artificial Sequence
  Synthetic
cagtcatttgggagcagcattgtacagg

SEQ ID NO: 7916 - DNA, 28 bp, Artificial Sequence
  Synthetic
cagtcatttgggtggagtgtgacaatgg

SEQ ID NO: 7917 - DNA, 28 bp, Artificial Sequence
  Synthetic
cagtcatttgggttaaggcacgcggtga

SEQ ID NO: 7918 - DNA, 28 bp, Artificial Sequence
  Synthetic
cagtcatttgggtccctgagaccctaac

SEQ ID NO: 7919 - DNA, 28 bp, Artificial Sequence
  Synthetic
cagtcatttgggtcacagtgaaccggtc

SEQ ID NO: 7920 - DNA, 28 bp, Artificial Sequence
  Synthetic
cagtcatttgggtatggctttttattcc

SEQ ID NO: 7921 - DNA, 28 bp, Artificial Sequence
  Synthetic
cagtcatttgggactccatttgttttga

SEQ ID NO: 7922 - DNA, 28 bp, Artificial Sequence
  Synthetic
cagtcatttgggtctacagtgcacgtgt

SEQ ID NO: 7923 - DNA, 28 bp, Artificial Sequence
  Synthetic
cagtcatttgggagtggttttaccctat

SEQ ID NO: 7924 - DNA, 28 bp, Artificial Sequence
  Synthetic
cagtcatttggggtccagttttcccagg

SEQ ID NO: 7925 - DNA, 28 bp, Artificial Sequence
  Synthetic
cagtcatttgggtcagtgcactacagaa

SEQ ID NO: 7926 - DNA, 28 bp, Artificial Sequence
  Synthetic
cagtcatttgggttgcatagtcacaaaa

SEQ ID NO: 7927 - DNA, 28 bp, Artificial Sequence
  Synthetic
cagtcatttgggccgcagcacatcatgg

SEQ ID NO: 7928 - DNA, 28 bp, Artificial Sequence
  Synthetic
cagtcatttgggtaaggtgcatctagtg

SEQ ID NO: 7929 - DNA, 28 bp, Artificial Sequence
  Synthetic
cagtcatttgggaacattcattgctgtc

SEQ ID NO: 7930 - DNA, 28 bp, Artificial Sequence
  Synthetic
cagtcatttgggaacattcaacctgtcg

SEQ ID NO: 7931 - DNA, 28 bp, Artificial Sequence
  Synthetic
cagtcatttgggtatggcactggtagaa

SEQ ID NO: 7932 - DNA, 28 bp, Artificial Sequence
  Synthetic
cagtcatttgggtggacggagaactgat

SEQ ID NO: 7933 - DNA, 28 bp, Artificial Sequence
  Synthetic
cagtcatttgggcaaagaattctccttt

SEQ ID NO: 7934 - DNA, 28 bp, Artificial Sequence
  Synthetic
cagtcatttgggtaggtagtttcatgtt

SEQ ID NO: 7935 - DNA, 28 bp, Artificial Sequence
  Synthetic
cagtcatttgggtgtgcaaatctatgca

SEQ ID NO: 7936 - DNA, 28 bp, Artificial Sequence
  Synthetic
cagtcatttgggtaaagtgcttatagtg

SEQ ID NO: 7937 - DNA, 28 bp, Artificial Sequence
  Synthetic
cagtcatttgggttccctttgtcatcct

SEQ ID NO: 7938 - DNA, 28 bp, Artificial Sequence
  Synthetic
cagtcatttgggtccttcattccaccgg

SEQ ID NO: 7939 - DNA, 28 bp, Artificial Sequence
  Synthetic
cagtcatttgggtagcttatcagactga

SEQ ID NO: 7940 - DNA, 28 bp, Artificial Sequence
  Synthetic
cagtcatttgggacagcaggcacagaca

SEQ ID NO: 7941 - DNA, 28 bp, Artificial Sequence
  Synthetic
cagtcatttgggtaatctcagctggcaa

SEQ ID NO: 7942 - DNA, 28 bp, Artificial Sequence
  Synthetic
cagtcatttgggtactgcatcaggaact

SEQ ID NO: 7943 - DNA, 28 bp, Artificial Sequence
  Synthetic
cagtcatttgggcaagtcactagtggtt

SEQ ID NO: 7944 - DNA, 28 bp, Artificial Sequence
  Synthetic
cagtcatttgggatcacattgccaggga

SEQ ID NO: 7945 - DNA, 28 bp, Artificial Sequence
  Synthetic
cagtcatttgggtggctcagttcagcag

SEQ ID NO: 7946 - DNA, 28 bp, Artificial Sequence
  Synthetic
cagtcatttgggttcaagtaatccagga

SEQ ID NO: 7947 - DNA, 28 bp, Artificial Sequence
  Synthetic
cagtcatttgggttcacagtggctaagt

SEQ ID NO: 7948 - DNA, 28 bp, Artificial Sequence
  Synthetic
cagtcatttgggaaggagctcacactct

SEQ ID NO: 7949 - DNA, 28 bp, Artificial Sequence
  Synthetic
cagtcatttgggtagcaccatttgaaat

SEQ ID NO: 7950 - DNA, 28 bp, Artificial Sequence
  Synthetic
cagtcatttgggtagcaccatttgaaat

SEQ ID NO: 7951 - DNA, 28 bp, Artificial Sequence
  Synthetic
cagtcatttgggcagtccaatagtattg

SEQ ID NO: 7952 - DNA, 28 bp, Artificial Sequence
  Synthetic
cagtcatttgggtgtaaacatcctacac

SEQ ID NO: 7953 - DNA, 28 bp, Artificial Sequence
  Synthetic
cagtcatttgggtattgcacattactaa

SEQ ID NO: 7954 - DNA, 28 bp, Artificial Sequence
  Synthetic
cagtcatttggggcacattacacggtcg

SEQ ID NO: 7955 - DNA, 28 bp, Artificial Sequence
  Synthetic
cagtcatttgggcctagtaggtgttcag

SEQ ID NO: 7956 - DNA, 28 bp, Artificial Sequence
  Synthetic
cagtcatttgggcctctgggcccttcct

SEQ ID NO: 7957 - DNA, 28 bp, Artificial Sequence
  Synthetic
cagtcatttgggtggaagactagtgatt

SEQ ID NO: 7958 - DNA, 28 bp, Artificial Sequence
  Synthetic
cagtcatttgggtctttggttatctagc

SEQ ID NO: 7959 - DNA, 28 bp, Artificial Sequence
  Synthetic
cagtcatttgggtctttggttatctagc

SEQ ID NO: 7960 - DNA, 28 bp, Artificial Sequence
  Synthetic
cagtcatttgggttcaacgggtatttat

SEQ ID NO: 7961 - DNA, 28 bp, Artificial Sequence
  Synthetic
cagtcatttggggcctgtttcatgccct

SEQ ID NO: 7962 - DNA, 28 bp, Artificial Sequence
  Synthetic
cagtcatttgggtgaggggcctgaaatg

SEQ ID NO: 7963 - DNA, 28 bp, Artificial Sequence
  Synthetic
cagtcatttgggtgaggtagtaggttgt

SEQ ID NO: 7964 - DNA, 28 bp, Artificial Sequence
  Synthetic
cagtcatttgggtgaggtagtaggttgt

SEQ ID NO: 7965 - DNA, 28 bp, Artificial Sequence
  Synthetic
cagtcatttgggtgaggtagttggttgt

SEQ ID NO: 7966 - DNA, 28 bp, Artificial Sequence
  Synthetic
cagtcatttgggtgaggtagtagattga

SEQ ID NO: 7967 - DNA, 28 bp, Artificial Sequence
  Synthetic
cagtcatttgggtgaggtagtagtttgt

SEQ ID NO: 7968 - DNA, 28 bp, Artificial Sequence
  Synthetic
cagtcatttgggtgaggtagtaagttgt

SEQ ID NO: 7969 - DNA, 28 bp, Artificial Sequence
  Synthetic
cagtcatttgggtgaggtagtagtttgt

SEQ ID NO: 7970 - DNA, 28 bp, Artificial Sequence
  Synthetic
cagtcatttgggtgaggtagttttttgt

SEQ ID NO: 7971 - DNA, 28 bp, Artificial Sequence
  Synthetic
cagtcatttgggtggaatgtaaagaagt

SEQ ID NO: 7972 - DNA, 28 bp, Artificial Sequence
  Synthetic
cagtcatttgggaacccgtagatccgaa

SEQ ID NO: 7973 - DNA, 28 bp, Artificial Sequence
  Synthetic
cagtcatttgggtacagtactgtgataa

SEQ ID NO: 7974 - DNA, 28 bp, Artificial Sequence
  Synthetic
cagtcatttgggtacagtactatgataa

SEQ ID NO: 7975 - DNA, 28 bp, Artificial Sequence
  Synthetic
cagtcatttgggagcagcattgtacagg

SEQ ID NO: 7976 - DNA, 28 bp, Artificial Sequence
  Synthetic
cagtcatttgggagcagcattgtacagg

SEQ ID NO: 7977 - DNA, 28 bp, Artificial Sequence
  Synthetic
cagtcatttgggtaccctgtagaaccga

SEQ ID NO: 7978 - DNA, 28 bp, Artificial Sequence
  Synthetic
cagtcatttgggtaccctgtagatccgg

SEQ ID NO: 7979 - DNA, 28 bp, Artificial Sequence
  Synthetic
cagtcatttgggtaccctgtagaaccga

SEQ ID NO: 7980 - DNA, 28 bp, Artificial Sequence
  Synthetic
cagtcatttgggtggagtgtgacaatgg

SEQ ID NO: 7981 - DNA, 28 bp, Artificial Sequence
  Synthetic
cagtcatttgggtaaggcacgcggtgaa

SEQ ID NO: 7982 - DNA, 28 bp, Artificial Sequence
  Synthetic
cagtcatttgggtccctgagacccttaa

SEQ ID NO: 7983 - DNA, 28 bp, Artificial Sequence
  Synthetic
cagtcatttgggtccctgagaccctaac

SEQ ID NO: 7984 - DNA, 28 bp, Artificial Sequence
  Synthetic
cagtcatttgggtcgtaccgtgagtaat

SEQ ID NO: 7985 - DNA, 28 bp, Artificial Sequence
  Synthetic
cagtcatttgggtcacagtgaaccggtc

SEQ ID NO: 7986 - DNA, 28 bp, Artificial Sequence
  Synthetic
cagtcatttgggctttttgcggtctggg

SEQ ID NO: 7987 - DNA, 28 bp, Artificial Sequence
  Synthetic
cagtcatttgggcagtgcaatattaaaa

SEQ ID NO: 7988 - DNA, 28 bp, Artificial Sequence
  Synthetic
cagtcatttgggtaacagtctacagcca

SEQ ID NO: 7989 - DNA, 28 bp, Artificial Sequence
  Synthetic
cagtcatttgggtttggtccccttcaac

SEQ ID NO: 7990 - DNA, 28 bp, Artificial Sequence
  Synthetic
cagtcatttgggtatggctttctattcc

SEQ ID NO: 7991 - DNA, 28 bp, Artificial Sequence
  Synthetic
cagtcatttgggtatggctttttattcc

SEQ ID NO: 7992 - DNA, 28 bp, Artificial Sequence
  Synthetic
cagtcatttgggttattgcttgagaata

SEQ ID NO: 7993 - DNA, 28 bp, Artificial Sequence
  Synthetic
cagtcatttgggagctggtgttgtgaat

SEQ ID NO: 7994 - DNA, 28 bp, Artificial Sequence
  Synthetic
cagtcatttgggcagtggttttacccta

SEQ ID NO: 7995 - DNA, 28 bp, Artificial Sequence
  Synthetic
cagtcatttgggcataaagtagaaagca

SEQ ID NO: 7996 - DNA, 28 bp, Artificial Sequence
  Synthetic
cagtcatttgggcataaagtagaaagca

SEQ ID NO: 7997 - DNA, 28 bp, Artificial Sequence
  Synthetic
cagtcatttgggtacagtatagatgatg

SEQ ID NO: 7998 - DNA, 28 bp, Artificial Sequence
  Synthetic
cagtcatttgggtcagtgcattacagaa

SEQ ID NO: 7999 - DNA, 28 bp, Artificial Sequence
  Synthetic
cagtcatttgggtcagtgcataacagaa

SEQ ID NO: 8000 - DNA, 28 bp, Artificial Sequence
  Synthetic
cagtcatttgggttgcatagtcacaaaa

SEQ ID NO: 8001 - DNA, 28 bp, Artificial Sequence
  Synthetic
cagtcatttgggttgcatagtcacaaaa

SEQ ID NO: 8002 - DNA, 28 bp, Artificial Sequence
  Synthetic
cagtcatttgggtagcagcacggaatgg

SEQ ID NO: 8003 - DNA, 28 bp, Artificial Sequence
  Synthetic
cagtcatttgggtagcagcgcatcatgg

SEQ ID NO: 8004 - DNA, 28 bp, Artificial Sequence
  Synthetic
cagtcatttgggtagcagcacgtaaata

SEQ ID NO: 8005 - DNA, 28 bp, Artificial Sequence
  Synthetic
cagtcatttgggcaaagtgcttacagtg

SEQ ID NO: 8006 - DNA, 28 bp, Artificial Sequence
  Synthetic
cagtcatttgggtaaggtgcatctagtg

SEQ ID NO: 8007 - DNA, 28 bp, Artificial Sequence
  Synthetic
cagtcatttgggaacattcaacgctgtc

SEQ ID NO: 8008 - DNA, 28 bp, Artificial Sequence
  Synthetic
cagtcatttgggaccatcgaccgttgat

SEQ ID NO: 8009 - DNA, 28 bp, Artificial Sequence
  Synthetic
cagtcatttgggaacattcattgctgtc

SEQ ID NO: 8010 - DNA, 28 bp, Artificial Sequence
  Synthetic
cagtcatttgggtggttctagacttgcc

SEQ ID NO: 8011 - DNA, 28 bp, Artificial Sequence
  Synthetic
cagtcatttgggtatggcactggtagaa

SEQ ID NO: 8012 - DNA, 28 bp, Artificial Sequence
  Synthetic
cagtcatttgggtggacggagaactgat

SEQ ID NO: 8013 - DNA, 28 bp, Artificial Sequence
  Synthetic
cagtcatttgggtcgtgtcttgtgttgc

SEQ ID NO: 8014 - DNA, 28 bp, Artificial Sequence
  Synthetic
cagtcatttgggtgatatgtttgatata

SEQ ID NO: 8015 - DNA, 28 bp, Artificial Sequence
  Synthetic
cagtcatttgggatgacctatgaattga

SEQ ID NO: 8016 - DNA, 28 bp, Artificial Sequence
  Synthetic
cagtcatttgggaactggcctacaaagt

SEQ ID NO: 8017 - DNA, 28 bp, Artificial Sequence
  Synthetic
cagtcatttgggtgtaacagcaactcca

SEQ ID NO: 8018 - DNA, 28 bp, Artificial Sequence
  Synthetic
cagtcatttgggtaggtagtttcatgtt

SEQ ID NO: 8019 - DNA, 28 bp, Artificial Sequence
  Synthetic
cagtcatttgggtaggtagtttcaagtt

SEQ ID NO: 8020 - DNA, 28 bp, Artificial Sequence
  Synthetic
cagtcatttgggcccagtgttcagacta

SEQ ID NO: 8021 - DNA, 28 bp, Artificial Sequence
  Synthetic
cagtcatttgggtgtgcaaatctatgca

SEQ ID NO: 8022 - DNA, 28 bp, Artificial Sequence
  Synthetic
cagtcatttgggtgtgcaaatccatgca

SEQ ID NO: 8023 - DNA, 28 bp, Artificial Sequence
  Synthetic
cagtcatttgggtaaagtgcttatagtg

SEQ ID NO: 8024 - DNA, 28 bp, Artificial Sequence
  Synthetic
cagtcatttgggtaacactgtctggtaa

SEQ ID NO: 8025 - DNA, 28 bp, Artificial Sequence
  Synthetic
cagtcatttgggtaatactgcctggtaa

SEQ ID NO: 8026 - DNA, 28 bp, Artificial Sequence
  Synthetic
cagtcatttgggagaggcatagggcatg

SEQ ID NO: 8027 - DNA, 28 bp, Artificial Sequence
  Synthetic
cagtcatttggggtgaaatgtttaggac

SEQ ID NO: 8028 - DNA, 28 bp, Artificial Sequence
  Synthetic
cagtcatttgggttccctttgtcatcct

SEQ ID NO: 8029 - DNA, 28 bp, Artificial Sequence
  Synthetic
cagtcatttgggttccctttgttatcct

SEQ ID NO: 8030 - DNA, 28 bp, Artificial Sequence
  Synthetic
cagtcatttgggtccttcattccaccgg

SEQ ID NO: 8031 - DNA, 28 bp, Artificial Sequence
  Synthetic
cagtcatttgggtagcttatcagactgg

SEQ ID NO: 8032 - DNA, 28 bp, Artificial Sequence
  Synthetic
cagtcatttgggctgtgcgtgtgacagc

SEQ ID NO: 8033 - DNA, 28 bp, Artificial Sequence
  Synthetic
cagtcatttgggtaacagtctacagtca

SEQ ID NO: 8034 - DNA, 28 bp, Artificial Sequence
  Synthetic
cagtcatttgggacagcaggcacagaca

SEQ ID NO: 8035 - DNA, 28 bp, Artificial Sequence
  Synthetic
cagtcatttgggaaatctcagctggcaa

SEQ ID NO: 8036 - DNA, 28 bp, Artificial Sequence
  Synthetic
cagtcatttgggtaatctctgcaggcaa

SEQ ID NO: 8037 - DNA, 28 bp, Artificial Sequence
  Synthetic
cagtcatttgggtactgcatcaggaact

SEQ ID NO: 8038 - DNA, 28 bp, Artificial Sequence
  Synthetic
cagtcatttgggttgtgcttgatctaac

SEQ ID NO: 8039 - DNA, 28 bp, Artificial Sequence
  Synthetic
cagtcatttgggttgtgcttgatctaac

SEQ ID NO: 8040 - DNA, 28 bp, Artificial Sequence
  Synthetic
cagtcatttgggtgattgtccaaacgca

SEQ ID NO: 8041 - DNA, 28 bp, Artificial Sequence
  Synthetic
cagtcatttgggagctacattgtctgct

SEQ ID NO: 8042 - DNA, 28 bp, Artificial Sequence
  Synthetic
cagtcatttgggagctacatctggctac

SEQ ID NO: 8043 - DNA, 28 bp, Artificial Sequence
  Synthetic
cagtcatttgggtgtcagtttgtcaaat

SEQ ID NO: 8044 - DNA, 28 bp, Artificial Sequence
  Synthetic
cagtcatttgggaagctgccagctgaag

SEQ ID NO: 8045 - DNA, 28 bp, Artificial Sequence
  Synthetic
cagtcatttgggaagctgccagttgaag

SEQ ID NO: 8046 - DNA, 28 bp, Artificial Sequence
  Synthetic
cagtcatttgggatcacattgccaggga

SEQ ID NO: 8047 - DNA, 28 bp, Artificial Sequence
  Synthetic
cagtcatttgggatcacattgccaggga

SEQ ID NO: 8048 - DNA, 28 bp, Artificial Sequence
  Synthetic
cagtcatttgggtggctcagttcagcag

SEQ ID NO: 8049 - DNA, 28 bp, Artificial Sequence
  Synthetic
cagtcatttgggcattgcacttgtctcg

SEQ ID NO: 8050 - DNA, 28 bp, Artificial Sequence
  Synthetic
cagtcatttgggttcaagtaatccagga

SEQ ID NO: 8051 - DNA, 28 bp, Artificial Sequence
  Synthetic
cagtcatttgggttcacagtggctaagt

SEQ ID NO: 8052 - DNA, 28 bp, Artificial Sequence
  Synthetic
cagtcatttgggttcacagtggttaagt

SEQ ID NO: 8053 - DNA, 28 bp, Artificial Sequence
  Synthetic
cagtcatttgggttcacagtggctaagt

SEQ ID NO: 8054 - DNA, 28 bp, Artificial Sequence
  Synthetic
cagtcatttgggtagcaccatttgaaat

SEQ ID NO: 8055 - DNA, 28 bp, Artificial Sequence
  Synthetic
cagtcatttgggtagcaccatttgaaat

SEQ ID NO: 8056 - DNA, 28 bp, Artificial Sequence
  Synthetic
cagtcatttgggcagtgcaatagtattg

SEQ ID NO: 8057 - DNA, 28 bp, Artificial Sequence
  Synthetic
cagtcatttgggtgtaaacatcctacac

SEQ ID NO: 8058 - DNA, 28 bp, Artificial Sequence
  Synthetic
cagtcatttgggtgtaaacatcctacac

SEQ ID NO: 8059 - DNA, 28 bp, Artificial Sequence
  Synthetic
cagtcatttgggtgtaaacatccccgac

SEQ ID NO: 8060 - DNA, 28 bp, Artificial Sequence
  Synthetic
cagtcatttgggtccagcatcagtgatt

SEQ ID NO: 8061 - DNA, 28 bp, Artificial Sequence
  Synthetic
cagtcatttgggtaatgcccctaaaaat

SEQ ID NO: 8062 - DNA, 28 bp, Artificial Sequence
  Synthetic
cagtcatttgggtttgttcgttcggctc

SEQ ID NO: 8063 - DNA, 28 bp, Artificial Sequence
  Synthetic
cagtcatttgggtaatactgtctggtaa

SEQ ID NO: 8064 - DNA, 28 bp, Artificial Sequence
  Synthetic
cagtcatttgggtatgtgcccttggact

SEQ ID NO: 8065 - DNA, 28 bp, Artificial Sequence
  Synthetic
cagtcatttgggatagctctttaaatgg

SEQ ID NO: 8066 - DNA, 28 bp, Artificial Sequence
  Synthetic
cagtcatttgggcacagcgcatacaatg

SEQ ID NO: 8067 - DNA, 28 bp, Artificial Sequence
  Synthetic
cagtcatttgggagtgacatcatatgta

SEQ ID NO: 8068 - DNA, 28 bp, Artificial Sequence
  Synthetic
cagtcatttgggtggaagactagtgatt

SEQ ID NO: 8069 - DNA, 28 bp, Artificial Sequence
  Synthetic
cagtcatttgggtctttggttatctagc

SEQ ID NO: 8070 - DNA, 28 bp, Artificial Sequence
  Synthetic
cagtcatttgggtattgcacttgtcccg

SEQ ID NO: 8071 - DNA, 28 bp, Artificial Sequence
  Synthetic
cagtcatttgggtttggcactagcacat

SEQ ID NO: 8072 - DNA, 28 bp, Artificial Sequence
  Synthetic
cagtcatttgggttggtccccttcaacc

SEQ ID NO: 8073 - DNA, 28 bp, Artificial Sequence
  Synthetic
cagtcatttgggtaaggtgcatctagtg

SEQ ID NO: 8074 - DNA, 28 bp, Artificial Sequence
  Synthetic
cagtcatttgggtgtgcaaatccatgca

SEQ ID NO: 8075 - DNA, 28 bp, Artificial Sequence
  Synthetic
cagtcatttgggcaaagtgctcatagtg

SEQ ID NO: 8076 - DNA, 28 bp, Artificial Sequence
  Synthetic
cagtcatttgggaaagtgctttctgttt

SEQ ID NO: 8077 - DNA, 28 bp, Artificial Sequence
  Synthetic
cagtcatttgggtaagtgctctctagtt

SEQ ID NO: 8078 - DNA, 28 bp, Artificial Sequence
  Synthetic
cagtcatttgggtaatactgtctggtaa

SEQ ID NO: 8079 - DNA, 28 bp, Artificial Sequence
  Synthetic
cagtcatttgggtgaggtagtaggttgt

SEQ ID NO: 8080 - DNA, 28 bp, Artificial Sequence
  Synthetic
cagtcatttgggtgaggtagtagtttgt

SEQ ID NO: 8081 - DNA, 28 bp, Artificial Sequence
  Synthetic
cagtcatttgggtgaggtagtaggttgt

SEQ ID NO: 8082 - DNA, 28 bp, Artificial Sequence
  Synthetic
cagtcatttgggtgaggtagtaggttgt

SEQ ID NO: 8083 - DNA, 28 bp, Artificial Sequence
  Synthetic
cagtcatttgggtgaggtagtagattgt

SEQ ID NO: 8084 - DNA, 28 bp, Artificial Sequence
  Synthetic
cagtcatttgggtgaggtagttgtttgt

SEQ ID NO: 8085 - DNA, 28 bp, Artificial Sequence
  Synthetic
cagtcatttgggtgaggtagtagtttgt

SEQ ID NO: 8086 - DNA, 28 bp, Artificial Sequence
  Synthetic
cagtcatttgggaacccgtagatccgaa

SEQ ID NO: 8087 - DNA, 28 bp, Artificial Sequence
  Synthetic
cagtcatttgggtacagtactgtgataa

SEQ ID NO: 8088 - DNA, 28 bp, Artificial Sequence
  Synthetic
cagtcatttgggagcagcattgtacagg

SEQ ID NO: 8089 - DNA, 28 bp, Artificial Sequence
  Synthetic
cagtcatttgggaaaagtgcttatagtg

SEQ ID NO: 8090 - DNA, 28 bp, Artificial Sequence
  Synthetic
cagtcatttgggagcagcattgtacagg

SEQ ID NO: 8091 - DNA, 28 bp, Artificial Sequence
  Synthetic
cagtcatttgggtaccctgtagatccga

SEQ ID NO: 8092 - DNA, 28 bp, Artificial Sequence
  Synthetic
cagtcatttgggtaccctgtagaaccga

SEQ ID NO: 8093 - DNA, 28 bp, Artificial Sequence
  Synthetic
cagtcatttgggcaccctgtagaatcga

SEQ ID NO: 8094 - DNA, 28 bp, Artificial Sequence
  Synthetic
cagtcatttgggtggagtgtgacaatgg

SEQ ID NO: 8095 - DNA, 28 bp, Artificial Sequence
  Synthetic
cagtcatttgggttaaggcacgcggtga

SEQ ID NO: 8096 - DNA, 28 bp, Artificial Sequence
  Synthetic
cagtcatttgggtccctgagacccttaa

SEQ ID NO: 8097 - DNA, 28 bp, Artificial Sequence
  Synthetic
cagtcatttgggtccctgagaccctaac

SEQ ID NO: 8098 - DNA, 28 bp, Artificial Sequence
  Synthetic
cagtcatttgggtcgtaccgtgagtaat

SEQ ID NO: 8099 - DNA, 28 bp, Artificial Sequence
  Synthetic
cagtcatttgggcattattacttttggt

SEQ ID NO: 8100 - DNA, 28 bp, Artificial Sequence
  Synthetic
cagtcatttgggtcacagtgaaccggtc

SEQ ID NO: 8101 - DNA, 28 bp, Artificial Sequence
  Synthetic
cagtcatttgggctttttgcggtctggg

SEQ ID NO: 8102 - DNA, 28 bp, Artificial Sequence
  Synthetic
cagtcatttgggcagtgcaatgttaaaa

SEQ ID NO: 8103 - DNA, 28 bp, Artificial Sequence
  Synthetic
cagtcatttgggcagtgcaatgatgaaa

SEQ ID NO: 8104 - DNA, 28 bp, Artificial Sequence
  Synthetic
cagtcatttgggcagtgcaatattaaaa

SEQ ID NO: 8105 - DNA, 28 bp, Artificial Sequence
  Synthetic
cagtcatttgggtaacagtctacagcca

SEQ ID NO: 8106 - DNA, 28 bp, Artificial Sequence
  Synthetic
cagtcatttgggttggtccccttcaacc

SEQ ID NO: 8107 - DNA, 28 bp, Artificial Sequence
  Synthetic
cagtcatttgggttggtccccttcaacc

SEQ ID NO: 8108 - DNA, 28 bp, Artificial Sequence
  Synthetic
cagtcatttgggttggtccccttcaacc

SEQ ID NO: 8109 - DNA, 28 bp, Artificial Sequence
  Synthetic
cagtcatttgggttggtccccttcaacc

SEQ ID NO: 8110 - DNA, 28 bp, Artificial Sequence
  Synthetic
cagtcatttgggtatggctttttattcc

SEQ ID NO: 8111 - DNA, 28 bp, Artificial Sequence
  Synthetic
cagtcatttgggtattgcttaagaatac

SEQ ID NO: 8112 - DNA, 28 bp, Artificial Sequence
  Synthetic
cagtcatttgggagctggtgttgtgaat

SEQ ID NO: 8113 - DNA, 28 bp, Artificial Sequence
  Synthetic
cagtcatttgggtctacagtgcatgtgt

SEQ ID NO: 8114 - DNA, 28 bp, Artificial Sequence
  Synthetic
cagtcatttgggagtggttttaccctat

SEQ ID NO: 8115 - DNA, 28 bp, Artificial Sequence
  Synthetic
cagtcatttgggtgtagtgtttcctact

SEQ ID NO: 8116 - DNA, 28 bp, Artificial Sequence
  Synthetic
cagtcatttgggcataaagtagaaagca

SEQ ID NO: 8117 - DNA, 28 bp, Artificial Sequence
  Synthetic
cagtcatttgggtgagatgaagcactgt

SEQ ID NO: 8118 - DNA, 28 bp, Artificial Sequence
  Synthetic
cagtcatttgggtacagtatagatgatg

SEQ ID NO: 8119 - DNA, 28 bp, Artificial Sequence
  Synthetic
cagtcatttggggtccagttttcccagg

SEQ ID NO: 8120 - DNA, 28 bp, Artificial Sequence
  Synthetic
cagtcatttgggtgagaactgaattcca

SEQ ID NO: 8121 - DNA, 28 bp, Artificial Sequence
  Synthetic
cagtcatttgggtcagtgcactacagaa

SEQ ID NO: 8122 - DNA, 28 bp, Artificial Sequence
  Synthetic
cagtcatttgggtcagtgcatcacagaa

SEQ ID NO: 8123 - DNA, 28 bp, Artificial Sequence
  Synthetic
cagtcatttgggtctcccaacccttgta

SEQ ID NO: 8124 - DNA, 28 bp, Artificial Sequence
  Synthetic
cagtcatttgggttgcatagtcacaaaa

SEQ ID NO: 8125 - DNA, 28 bp, Artificial Sequence
  Synthetic
cagtcatttgggttaatgctaatcgtga

SEQ ID NO: 8126 - DNA, 28 bp, Artificial Sequence
  Synthetic
cagtcatttgggtagcagcacataatgg

SEQ ID NO: 8127 - DNA, 28 bp, Artificial Sequence
  Synthetic
cagtcatttgggtagcagcacatcatga

SEQ ID NO: 8128 - DNA, 28 bp, Artificial Sequence
  Synthetic
cagtcatttgggtagcagcacatcatgg

SEQ ID NO: 8129 - DNA, 28 bp, Artificial Sequence
  Synthetic
cagtcatttgggtagcagcacgtaaata

SEQ ID NO: 8130 - DNA, 28 bp, Artificial Sequence
  Synthetic
cagtcatttgggtagcagcacgtaaata

SEQ ID NO: 8131 - DNA, 28 bp, Artificial Sequence
  Synthetic
cagtcatttgggtagcagcacgtaaata

SEQ ID NO: 8132 - DNA, 28 bp, Artificial Sequence
  Synthetic
cagtcatttgggactgcagtgaaggcac

SEQ ID NO: 8133 - DNA, 28 bp, Artificial Sequence
  Synthetic
cagtcatttgggcaaagtgcttacagtg

SEQ ID NO: 8134 - DNA, 28 bp, Artificial Sequence
  Synthetic
cagtcatttgggaacattcaacgctgtc

SEQ ID NO: 8135 - DNA, 28 bp, Artificial Sequence
  Synthetic
cagtcatttgggaccatcgatcgttgac

SEQ ID NO: 8136 - DNA, 28 bp, Artificial Sequence
  Synthetic
cagtcatttgggaacattcattgctgtc

SEQ ID NO: 8137 - DNA, 28 bp, Artificial Sequence
  Synthetic
cagtcatttgggtttggcaatggtagaa

SEQ ID NO: 8138 - DNA, 28 bp, Artificial Sequence
  Synthetic
cagtcatttgggtggttctagacttgcc

SEQ ID NO: 8139 - DNA, 28 bp, Artificial Sequence
  Synthetic
cagtcatttgggtatggcactggtagaa

SEQ ID NO: 8140 - DNA, 28 bp, Artificial Sequence
  Synthetic
cagtcatttgggtggacggagaactgat

SEQ ID NO: 8141 - DNA, 28 bp, Artificial Sequence
  Synthetic
cagtcatttgggtcgtgtcttgtgttgc

SEQ ID NO: 8142 - DNA, 28 bp, Artificial Sequence
  Synthetic
cagtcatttggggtgcctactgaactga

SEQ ID NO: 8143 - DNA, 28 bp, Artificial Sequence
  Synthetic
cagtcatttgggtaaggtgcatctagtg

SEQ ID NO: 8144 - DNA, 28 bp, Artificial Sequence
  Synthetic
cagtcatttgggtaaggtgcatctagtg

SEQ ID NO: 8145 - DNA, 28 bp, Artificial Sequence
  Synthetic
cagtcatttgggcaacggaatcccaaaa

SEQ ID NO: 8146 - DNA, 28 bp, Artificial Sequence
  Synthetic
cagtcatttgggatgacctatgaattga

SEQ ID NO: 8147 - DNA, 28 bp, Artificial Sequence
  Synthetic
cagtcatttgggaactggcccgcaaagt

SEQ ID NO: 8148 - DNA, 28 bp, Artificial Sequence
  Synthetic
cagtcatttgggtgtaacagcaactcca

SEQ ID NO: 8149 - DNA, 28 bp, Artificial Sequence
  Synthetic
cagtcatttgggtaggtagtttcatgtt

SEQ ID NO: 8150 - DNA, 28 bp, Artificial Sequence
  Synthetic
cagtcatttgggtaggtagttttatgtt

SEQ ID NO: 8151 - DNA, 28 bp, Artificial Sequence
  Synthetic
cagtcatttgggcccagtgttcagacta

SEQ ID NO: 8152 - DNA, 28 bp, Artificial Sequence
  Synthetic
cagtcatttgggtacagtagtctgcaca

SEQ ID NO: 8153 - DNA, 28 bp, Artificial Sequence
  Synthetic
cagtcatttgggcccagtgttcagacta

SEQ ID NO: 8154 - DNA, 28 bp, Artificial Sequence
  Synthetic
cagtcatttgggtgtgcaaatctatgca

SEQ ID NO: 8155 - DNA, 28 bp, Artificial Sequence
  Synthetic
cagtcatttgggtgtgcaaatccatgca

SEQ ID NO: 8156 - DNA, 28 bp, Artificial Sequence
  Synthetic
cagtcatttgggtggaatgtaaagaagt

SEQ ID NO: 8157 - DNA, 28 bp, Artificial Sequence
  Synthetic
cagtcatttgggtggaatgttaagaagt

SEQ ID NO: 8158 - DNA, 28 bp, Artificial Sequence
  Synthetic
cagtcatttgggtaacactgtctggtaa

SEQ ID NO: 8159 - DNA, 28 bp, Artificial Sequence
  Synthetic
cagtcatttgggtaatactgcctggtaa

SEQ ID NO: 8160 - DNA, 28 bp, Artificial Sequence
  Synthetic
cagtcatttgggaggggcatagggcatg

SEQ ID NO: 8161 - DNA, 28 bp, Artificial Sequence
  Synthetic
cagtcatttgggtttcctatgcatatac

SEQ ID NO: 8162 - DNA, 28 bp, Artificial Sequence
  Synthetic
cagtcatttggggtgaaatgtttaggac

SEQ ID NO: 8163 - DNA, 28 bp, Artificial Sequence
  Synthetic
cagtcatttgggttccctttgtcatcct

SEQ ID NO: 8164 - DNA, 28 bp, Artificial Sequence
  Synthetic
cagtcatttgggtccttcattccaccgg

SEQ ID NO: 8165 - DNA, 28 bp, Artificial Sequence
  Synthetic
cagtcatttgggtccttcattccaccgg

SEQ ID NO: 8166 - DNA, 28 bp, Artificial Sequence
  Synthetic
cagtcatttgggtggaatgtaaggaagt

SEQ ID NO: 8167 - DNA, 28 bp, Artificial Sequence
  Synthetic
cagtcatttgggataagacgagcataaa

SEQ ID NO: 8168 - DNA, 28 bp, Artificial Sequence
  Synthetic
cagtcatttgggtaaagtgcttatagtg

SEQ ID NO: 8169 - DNA, 28 bp, Artificial Sequence
  Synthetic
cagtcatttgggactgcataatgagcac

SEQ ID NO: 8170 - DNA, 28 bp, Artificial Sequence
  Synthetic
cagtcatttgggcaaagtgctcatagtg

SEQ ID NO: 8171 - DNA, 28 bp, Artificial Sequence
  Synthetic
cagtcatttgggctgtgcgtgtgacagc

SEQ ID NO: 8172 - DNA, 28 bp, Artificial Sequence
  Synthetic
cagtcatttgggtaacagtctacagtca

SEQ ID NO: 8173 - DNA, 28 bp, Artificial Sequence
  Synthetic
cagtcatttgggacagcaggcacagaca

SEQ ID NO: 8174 - DNA, 28 bp, Artificial Sequence
  Synthetic
cagtcatttgggatgacctatgaaatga

SEQ ID NO: 8175 - DNA, 28 bp, Artificial Sequence
  Synthetic
cagtcatttgggtaatctcagctggcaa

SEQ ID NO: 8176 - DNA, 28 bp, Artificial Sequence
  Synthetic
cagtcatttgggtactgcatcaggaact

SEQ ID NO: 8177 - DNA, 28 bp, Artificial Sequence
  Synthetic
cagtcatttgggttgtgcttgatctaac

SEQ ID NO: 8178 - DNA, 28 bp, Artificial Sequence
  Synthetic
cagtcatttgggtgattgtccaaacgca

SEQ ID NO: 8179 - DNA, 28 bp, Artificial Sequence
  Synthetic
cagtcatttgggaagctgccagttgaag

SEQ ID NO: 8180 - DNA, 28 bp, Artificial Sequence
  Synthetic
cagtcatttgggagttcttcagtggcaa

SEQ ID NO: 8181 - DNA, 28 bp, Artificial Sequence
  Synthetic
cagtcatttgggagctacattgtctgct

SEQ ID NO: 8182 - DNA, 28 bp, Artificial Sequence
  Synthetic
cagtcatttgggagctacatctggctac

SEQ ID NO: 8183 - DNA, 28 bp, Artificial Sequence
  Synthetic
cagtcatttgggtgtcagtttgtcaaat

SEQ ID NO: 8184 - DNA, 28 bp, Artificial Sequence
  Synthetic
cagtcatttgggatcacattgccaggga

SEQ ID NO: 8185 - DNA, 28 bp, Artificial Sequence
  Synthetic
cagtcatttgggatcacattgccaggga

SEQ ID NO: 8186 - DNA, 28 bp, Artificial Sequence
  Synthetic
cagtcatttgggtggctcagttcagcag

SEQ ID NO: 8187 - DNA, 28 bp, Artificial Sequence
  Synthetic
cagtcatttgggtggctcagttcagcag

SEQ ID NO: 8188 - DNA, 28 bp, Artificial Sequence
  Synthetic
cagtcatttgggcattgcacttgtctcg

SEQ ID NO: 8189 - DNA, 28 bp, Artificial Sequence
  Synthetic
cagtcatttgggttcaagtaatccagga

SEQ ID NO: 8190 - DNA, 28 bp, Artificial Sequence
  Synthetic
cagtcatttgggttcacagtggctaagt

SEQ ID NO: 8191 - DNA, 28 bp, Artificial Sequence
  Synthetic
cagtcatttgggttcacagtggctaagt

SEQ ID NO: 8192 - DNA, 28 bp, Artificial Sequence
  Synthetic
cagtcatttgggttcacagtggctaagt

SEQ ID NO: 8193 - DNA, 28 bp, Artificial Sequence
  Synthetic
cagtcatttgggtagcaccatttgaaat

SEQ ID NO: 8194 - DNA, 28 bp, Artificial Sequence
  Synthetic
cagtcatttgggtagcaccatttgaaat

SEQ ID NO: 8195 - DNA, 28 bp, Artificial Sequence
  Synthetic
cagtcatttgggtagcaccatttgaaat

SEQ ID NO: 8196 - DNA, 28 bp, Artificial Sequence
  Synthetic
cagtcatttgggtgaccgatctctcttg

SEQ ID NO: 8197 - DNA, 28 bp, Artificial Sequence
  Synthetic
cagtcatttgggtagcaccatatgaaat

SEQ ID NO: 8198 - DNA, 28 bp, Artificial Sequence
  Synthetic
cagtcatttgggcagtgcaatagtattg

SEQ ID NO: 8199 - DNA, 28 bp, Artificial Sequence
  Synthetic
cagtcatttgggtaagtgctccaatgtt

SEQ ID NO: 8200 - DNA, 28 bp, Artificial Sequence
  Synthetic
cagtcatttgggctttcagtcagatgtt

SEQ ID NO: 8201 - DNA, 28 bp, Artificial Sequence
  Synthetic
cagtcatttgggtgtaaacatcctcgac

SEQ ID NO: 8202 - DNA, 28 bp, Artificial Sequence
  Synthetic
cagtcatttgggtgtaaacatcctacac

SEQ ID NO: 8203 - DNA, 28 bp, Artificial Sequence
  Synthetic
cagtcatttgggtgtaaacatcctacac

SEQ ID NO: 8204 - DNA, 28 bp, Artificial Sequence
  Synthetic
cagtcatttgggtgtaaacatccccgac

SEQ ID NO: 8205 - DNA, 28 bp, Artificial Sequence
  Synthetic
cagtcatttgggtgtaaacatccttgac

SEQ ID NO: 8206 - DNA, 28 bp, Artificial Sequence
  Synthetic
cagtcatttgggaggcaagatgttggca

SEQ ID NO: 8207 - DNA, 28 bp, Artificial Sequence
  Synthetic
cagtcatttgggtccagcatcagtgatt

SEQ ID NO: 8208 - DNA, 28 bp, Artificial Sequence
  Synthetic
cagtcatttggggtgcattgtagttgca

SEQ ID NO: 8209 - DNA, 28 bp, Artificial Sequence
  Synthetic
cagtcatttggggtgcattgttgttgca

SEQ ID NO: 8210 - DNA, 28 bp, Artificial Sequence
  Synthetic
cagtcatttgggtggcagtgtcttagct

SEQ ID NO: 8211 - DNA, 28 bp, Artificial Sequence
  Synthetic
cagtcatttgggcaggcagtgtagttag

SEQ ID NO: 8212 - DNA, 28 bp, Artificial Sequence
  Synthetic
cagtcatttgggaattgcacggtatcca

SEQ ID NO: 8213 - DNA, 28 bp, Artificial Sequence
  Synthetic
cagtcatttgggcgggtggatcacgatg

SEQ ID NO: 8214 - DNA, 28 bp, Artificial Sequence
  Synthetic
cagtcatttgggtaatgcccctaaaaat

SEQ ID NO: 8215 - DNA, 28 bp, Artificial Sequence
  Synthetic
cagtcatttgggaattgcactgtagcaa

SEQ ID NO: 8216 - DNA, 28 bp, Artificial Sequence
  Synthetic
cagtcatttgggagatcagaaggtgatt

SEQ ID NO: 8217 - DNA, 28 bp, Artificial Sequence
  Synthetic
cagtcatttgggaatgacacgatcactc

SEQ ID NO: 8218 - DNA, 28 bp, Artificial Sequence
  Synthetic
cagtcatttgggtaagtgctctctagtt

SEQ ID NO: 8219 - DNA, 28 bp, Artificial Sequence
  Synthetic
cagtcatttgggtaatactgtctggtaa

SEQ ID NO: 8220 - DNA, 28 bp, Artificial Sequence
  Synthetic
cagtcatttgggaggcagtgtaatgtta

SEQ ID NO: 8221 - DNA, 28 bp, Artificial Sequence
  Synthetic
cagtcatttgggaaaccgttaccattac

SEQ ID NO: 8222 - DNA, 28 bp, Artificial Sequence
  Synthetic
cagtcatttgggtatgtgcccttggact

SEQ ID NO: 8223 - DNA, 28 bp, Artificial Sequence
  Synthetic
cagtcatttgggagtgacatcatatgta

SEQ ID NO: 8224 - DNA, 28 bp, Artificial Sequence
  Synthetic
cagtcatttgggttaagacttgcagtga

SEQ ID NO: 8225 - DNA, 28 bp, Artificial Sequence
  Synthetic
cagtcatttgggtggaagactagtgatt

SEQ ID NO: 8226 - DNA, 28 bp, Artificial Sequence
  Synthetic
cagtcatttgggtctttggttatctagc

SEQ ID NO: 8227 - DNA, 28 bp, Artificial Sequence
  Synthetic
cagtcatttgggtaaagctagataaccg

SEQ ID NO: 8228 - DNA, 28 bp, Artificial Sequence
  Synthetic
cagtcatttgggtattgcacttgtcccg

SEQ ID NO: 8229 - DNA, 28 bp, Artificial Sequence
  Synthetic
cagtcatttgggtattgcactcgtcccg

SEQ ID NO: 8230 - DNA, 28 bp, Artificial Sequence
  Synthetic
cagtcatttgggcaaagtgctgttcgtg

SEQ ID NO: 8231 - DNA, 28 bp, Artificial Sequence
  Synthetic
cagtcatttgggtcaagtgctgttcgtg

SEQ ID NO: 8232 - DNA, 28 bp, Artificial Sequence
  Synthetic
cagtcatttgggtttggcactagcacat

SEQ ID NO: 8233 - DNA, 28 bp, Artificial Sequence
  Synthetic
cagtcatttgggtgaggtagtaagttgt

SEQ ID NO: 8234 - DNA, 28 bp, Artificial Sequence
  Synthetic
cagtcatttgggaacccgtagatccgat

SEQ ID NO: 8235 - DNA, 28 bp, Artificial Sequence
  Synthetic
cagtcatttgggtctttggttatctagc

SEQ ID NO: 8236 - DNA, 28 bp, Artificial Sequence
  Synthetic
cagtcatttgggtaaagctagataaccg

SEQ ID NO: 8237 - DNA, 28 bp, Artificial Sequence
  Synthetic
cagtcatttgggtctttggttacctagc

SEQ ID NO: 8238 - DNA, 28 bp, Artificial Sequence
  Synthetic
cagtcatttgggtaaagctagacaaccg

SEQ ID NO: 8239 - DNA, 28 bp, Artificial Sequence
  Synthetic
cagtcatttgggtgacagaagagagtga

SEQ ID NO: 8240 - DNA, 28 bp, Artificial Sequence
  Synthetic
cagtcatttgggtgacagaagagagtga

SEQ ID NO: 8241 - DNA, 28 bp, Artificial Sequence
  Synthetic
cagtcatttgggtgacagaagagagtga

SEQ ID NO: 8242 - DNA, 28 bp, Artificial Sequence
  Synthetic
cagtcatttgggtgacagaagagagtga

SEQ ID NO: 8243 - DNA, 28 bp, Artificial Sequence
  Synthetic
cagtcatttgggtgacagaagagagtga

SEQ ID NO: 8244 - DNA, 28 bp, Artificial Sequence
  Synthetic
cagtcatttgggtgacagaagagagtga

SEQ ID NO: 8245 - DNA, 28 bp, Artificial Sequence
  Synthetic
cagtcatttgggtgacagaagagagtga

SEQ ID NO: 8246 - DNA, 28 bp, Artificial Sequence
  Synthetic
cagtcatttgggtgacagaagagagtga

SEQ ID NO: 8247 - DNA, 28 bp, Artificial Sequence
  Synthetic
cagtcatttgggtgacagaagagagtga

SEQ ID NO: 8248 - DNA, 28 bp, Artificial Sequence
  Synthetic
cagtcatttgggtgacagaagagagaga

SEQ ID NO: 8249 - DNA, 28 bp, Artificial Sequence
  Synthetic
cagtcatttgggtgacagaagagagcga

SEQ ID NO: 8250 - DNA, 28 bp, Artificial Sequence
  Synthetic
cagtcatttgggtttggattgaagggag

SEQ ID NO: 8251 - DNA, 28 bp, Artificial Sequence
  Synthetic
cagtcatttgggtttggattgaagggag

SEQ ID NO: 8252 - DNA, 28 bp, Artificial Sequence
  Synthetic
cagtcatttgggcttggattgaagggag

SEQ ID NO: 8253 - DNA, 28 bp, Artificial Sequence
  Synthetic
cagtcatttgggcttggattgaagggag

SEQ ID NO: 8254 - DNA, 28 bp, Artificial Sequence
  Synthetic
cagtcatttgggtgcctggctccctgta

SEQ ID NO: 8255 - DNA, 28 bp, Artificial Sequence
  Synthetic
cagtcatttgggtgcctggctccctgta

SEQ ID NO: 8256 - DNA, 28 bp, Artificial Sequence
  Synthetic
cagtcatttgggtgcctggctccctgta

SEQ ID NO: 8257 - DNA, 28 bp, Artificial Sequence
  Synthetic
cagtcatttgggtgcctggctccctgta

SEQ ID NO: 8258 - DNA, 28 bp, Artificial Sequence
  Synthetic
cagtcatttgggtgcctggctccctgta

SEQ ID NO: 8259 - DNA, 28 bp, Artificial Sequence
  Synthetic
cagtcatttgggtgcctggctccctgta

SEQ ID NO: 8260 - DNA, 28 bp, Artificial Sequence
  Synthetic
cagtcatttgggtcgataaacctctgca

SEQ ID NO: 8261 - DNA, 28 bp, Artificial Sequence
  Synthetic
cagtcatttgggtggagaagcagggcac

SEQ ID NO: 8262 - DNA, 28 bp, Artificial Sequence
  Synthetic
cagtcatttgggtggagaagcagggcac

SEQ ID NO: 8263 - DNA, 28 bp, Artificial Sequence
  Synthetic
cagtcatttgggtggagaagcagggcac

SEQ ID NO: 8264 - DNA, 28 bp, Artificial Sequence
  Synthetic
cagtcatttgggtggagaagcagggcac

SEQ ID NO: 8265 - DNA, 28 bp, Artificial Sequence
  Synthetic
cagtcatttgggtcggaccaggcttcat

SEQ ID NO: 8266 - DNA, 28 bp, Artificial Sequence
  Synthetic
cagtcatttgggtcggaccaggcttcat

SEQ ID NO: 8267 - DNA, 28 bp, Artificial Sequence
  Synthetic
cagtcatttgggtcggaccaggcttcat

SEQ ID NO: 8268 - DNA, 28 bp, Artificial Sequence
  Synthetic
cagtcatttgggtcggaccaggcttcat

SEQ ID NO: 8269 - DNA, 28 bp, Artificial Sequence
  Synthetic
cagtcatttgggtcggaccaggcttcat

SEQ ID NO: 8270 - DNA, 28 bp, Artificial Sequence
  Synthetic
cagtcatttgggtcggaccaggcttcat

SEQ ID NO: 8271 - DNA, 28 bp, Artificial Sequence
  Synthetic
cagtcatttgggtcggaccaggcttcat

SEQ ID NO: 8272 - DNA, 28 bp, Artificial Sequence
  Synthetic
cagtcatttgggtcggaccaggcttcat

SEQ ID NO: 8273 - DNA, 28 bp, Artificial Sequence
  Synthetic
cagtcatttgggtcggaccaggcttcat

SEQ ID NO: 8274 - DNA, 28 bp, Artificial Sequence
  Synthetic
cagtcatttgggtcggaccaggcttcaa

SEQ ID NO: 8275 - DNA, 28 bp, Artificial Sequence
  Synthetic
cagtcatttgggtcggaccaggcttcaa

SEQ ID NO: 8276 - DNA, 28 bp, Artificial Sequence
  Synthetic
cagtcatttgggtcggaccaggcttcat

SEQ ID NO: 8277 - DNA, 28 bp, Artificial Sequence
  Synthetic
cagtcatttgggtcggaccaggcttcat

SEQ ID NO: 8278 - DNA, 28 bp, Artificial Sequence
  Synthetic
cagtcatttgggtgaagctgccagcatg

SEQ ID NO: 8279 - DNA, 28 bp, Artificial Sequence
  Synthetic
cagtcatttgggtgaagctgccagcatg

SEQ ID NO: 8280 - DNA, 28 bp, Artificial Sequence
  Synthetic
cagtcatttgggtgaagctgccagcatg

SEQ ID NO: 8281 - DNA, 28 bp, Artificial Sequence
  Synthetic
cagtcatttgggtgaagctgccagcatg

SEQ ID NO: 8282 - DNA, 28 bp, Artificial Sequence
  Synthetic
cagtcatttgggtgaagctgccagcatg

SEQ ID NO: 8283 - DNA, 28 bp, Artificial Sequence
  Synthetic
cagtcatttgggtgaagctgccagcatg

SEQ ID NO: 8284 - DNA, 28 bp, Artificial Sequence
  Synthetic
cagtcatttgggtgaagctgccagcatg

SEQ ID NO: 8285 - DNA, 28 bp, Artificial Sequence
  Synthetic
cagtcatttgggtgaagctgccagcatg

SEQ ID NO: 8286 - DNA, 28 bp, Artificial Sequence
  Synthetic
cagtcatttgggtgaagctgccagcatg

SEQ ID NO: 8287 - DNA, 28 bp, Artificial Sequence
  Synthetic
cagtcatttgggtcgcttggtgcagatc

SEQ ID NO: 8288 - DNA, 28 bp, Artificial Sequence
  Synthetic
cagtcatttgggtcgcttggtgcagatc

SEQ ID NO: 8289 - DNA, 28 bp, Artificial Sequence
  Synthetic
cagtcatttgggcagccaaggatgactt

SEQ ID NO: 8290 - DNA, 28 bp, Artificial Sequence
  Synthetic
cagtcatttgggcagccaaggatgactt

SEQ ID NO: 8291 - DNA, 28 bp, Artificial Sequence
  Synthetic
cagtcatttgggcagccaaggatgactt

SEQ ID NO: 8292 - DNA, 28 bp, Artificial Sequence
  Synthetic
cagtcatttgggtagccaaggagactgc

SEQ ID NO: 8293 - DNA, 28 bp, Artificial Sequence
  Synthetic
cagtcatttgggtagccaaggagactgc

SEQ ID NO: 8294 - DNA, 28 bp, Artificial Sequence
  Synthetic
cagtcatttgggtagccaaggatgactt

SEQ ID NO: 8295 - DNA, 28 bp, Artificial Sequence
  Synthetic
cagtcatttgggtagccaaggatgactt

SEQ ID NO: 8296 - DNA, 28 bp, Artificial Sequence
  Synthetic
cagtcatttgggtagccaaggatgactt

SEQ ID NO: 8297 - DNA, 28 bp, Artificial Sequence
  Synthetic
cagtcatttgggtagccaaggatgactt

SEQ ID NO: 8298 - DNA, 28 bp, Artificial Sequence
  Synthetic
cagtcatttgggtagccaaggatgactt

SEQ ID NO: 8299 - DNA, 28 bp, Artificial Sequence
  Synthetic
cagtcatttgggtagccaaggatgactt

SEQ ID NO: 8300 - DNA, 28 bp, Artificial Sequence
  Synthetic
cagtcatttgggtgattgagccgcgcca

SEQ ID NO: 8301 - DNA, 28 bp, Artificial Sequence
  Synthetic
cagtcatttgggttgagccgtgccaata

SEQ ID NO: 8302 - DNA, 28 bp, Artificial Sequence
  Synthetic
cagtcatttgggtgactgagccgtgcca

SEQ ID NO: 8303 - DNA, 28 bp, Artificial Sequence
  Synthetic
cagtcatttgggtgattgagccgtgcca

SEQ ID NO: 8304 - DNA, 28 bp, Artificial Sequence
  Synthetic
cagtcatttgggtgattgagccgtgcca

SEQ ID NO: 8305 - DNA, 28 bp, Artificial Sequence
  Synthetic
cagtcatttgggttgagccgtgccaata

SEQ ID NO: 8306 - DNA, 28 bp, Artificial Sequence
  Synthetic
cagtcatttggggaggtgagccgagcca

SEQ ID NO: 8307 - DNA, 28 bp, Artificial Sequence
  Synthetic
cagtcatttggggtgagccgaaccaata

SEQ ID NO: 8308 - DNA, 28 bp, Artificial Sequence
  Synthetic
cagtcatttgggtgattgagccgtgcca

SEQ ID NO: 8309 - DNA, 28 bp, Artificial Sequence
  Synthetic
cagtcatttgggtgattgagccgtgcca

SEQ ID NO: 8310 - DNA, 28 bp, Artificial Sequence
  Synthetic
cagtcatttggggtgagccgaaccaata

SEQ ID NO: 8311 - DNA, 28 bp, Artificial Sequence
  Synthetic
cagtcatttgggagaatcttgatgatgc

SEQ ID NO: 8312 - DNA, 28 bp, Artificial Sequence
  Synthetic
cagtcatttgggagaatcttgatgatgc

SEQ ID NO: 8313 - DNA, 28 bp, Artificial Sequence
  Synthetic
cagtcatttgggagaatcttgatgatgc

SEQ ID NO: 8314 - DNA, 28 bp, Artificial Sequence
  Synthetic
cagtcatttgggagaatcttgatgatgc

SEQ ID NO: 8315 - DNA, 28 bp, Artificial Sequence
  Synthetic
cagtcatttgggggaatcttgatgatgc

SEQ ID NO: 8316 - DNA, 28 bp, Artificial Sequence
  Synthetic
cagtcatttgggttggactgaagggtgc

SEQ ID NO: 8317 - DNA, 28 bp, Artificial Sequence
  Synthetic
cagtcatttgggttggactgaagggtgc

SEQ ID NO: 8318 - DNA, 28 bp, Artificial Sequence
  Synthetic
cagtcatttgggttggactgaagggtgc

SEQ ID NO: 8319 - DNA, 28 bp, Artificial Sequence
  Synthetic
cagtcatttgggttggactgaagggtgc

SEQ ID NO: 8320 - DNA, 28 bp, Artificial Sequence
  Synthetic
cagtcatttgggtccaaagggatcgcat

SEQ ID NO: 8321 - DNA, 28 bp, Artificial Sequence
  Synthetic
cagtcatttgggttggcattctgtccac

SEQ ID NO: 8322 - DNA, 28 bp, Artificial Sequence
  Synthetic
cagtcatttgggttggcattctgtccac

SEQ ID NO: 8323 - DNA, 28 bp, Artificial Sequence
  Synthetic
cagtcatttggggtgaagtgtttggggg

SEQ ID NO: 8324 - DNA, 28 bp, Artificial Sequence
  Synthetic
cagtcatttggggtgaagtgtttggggg

SEQ ID NO: 8325 - DNA, 28 bp, Artificial Sequence
  Synthetic
cagtcatttggggtgaagtgtttggagg

SEQ ID NO: 8326 - DNA, 28 bp, Artificial Sequence
  Synthetic
cagtcatttgggttccacagctttcttg

SEQ ID NO: 8327 - DNA, 28 bp, Artificial Sequence
  Synthetic
cagtcatttgggttccacagctttcttg

SEQ ID NO: 8328 - DNA, 28 bp, Artificial Sequence
  Synthetic
cagtcatttgggtgccaaaggagaattg

SEQ ID NO: 8329 - DNA, 28 bp, Artificial Sequence
  Synthetic
cagtcatttgggtgccaaaggagagctg

SEQ ID NO: 8330 - DNA, 28 bp, Artificial Sequence
  Synthetic
cagtcatttgggtgccaaaggagaattg

SEQ ID NO: 8331 - DNA, 28 bp, Artificial Sequence
  Synthetic
cagtcatttgggtgccaaaggagagctg

SEQ ID NO: 8332 - DNA, 28 bp, Artificial Sequence
  Synthetic
cagtcatttgggtgccaaaggagagttg

SEQ ID NO: 8333 - DNA, 28 bp, Artificial Sequence
  Synthetic
cagtcatttgggtgccaaaggaaatttg

SEQ ID NO: 8334 - DNA, 28 bp, Artificial Sequence
  Synthetic
cagtcatttgggctgcactgcctcttcc

SEQ ID NO: 8335 - DNA, 23 bp, Artificial Sequence
  Synthetic
ccgttttttttttttaatcagct

SEQ ID NO: 8336 - DNA, 23 bp, Artificial Sequence
  Synthetic
ccgttttttttttttactataca

SEQ ID NO: 8337 - DNA, 23 bp, Artificial Sequence
  Synthetic
ccgttttttttttttctccatac

SEQ ID NO: 8338 - DNA, 23 bp, Artificial Sequence
  Synthetic
ccgttttttttttttacaaattc

SEQ ID NO: 8339 - DNA, 23 bp, Artificial Sequence
  Synthetic
ccgttttttttttttcacaagtt

SEQ ID NO: 8340 - DNA, 23 bp, Artificial Sequence
  Synthetic
ccgttttttttttttcttggcat

SEQ ID NO: 8341 - DNA, 23 bp, Artificial Sequence
  Synthetic
ccgttttttttttttcacaagtt

SEQ ID NO: 8342 - DNA, 23 bp, Artificial Sequence
  Synthetic
ccgttttttttttttacagctgg

SEQ ID NO: 8343 - DNA, 23 bp, Artificial Sequence
  Synthetic
ccgttttttttttttactcgtca

SEQ ID NO: 8344 - DNA, 23 bp, Artificial Sequence
  Synthetic
ccgttttttttttttaggagaga

SEQ ID NO: 8345 - DNA, 23 bp, Artificial Sequence
  Synthetic
ccgttttttttttttcccttatc

SEQ ID NO: 8346 - DNA, 23 bp, Artificial Sequence
  Synthetic
ccgttttttttttttatcacagc

SEQ ID NO: 8347 - DNA, 23 bp, Artificial Sequence
  Synthetic
ccgttttttttttttagccgttg

SEQ ID NO: 8348 - DNA, 23 bp, Artificial Sequence
  Synthetic
ccgttttttttttttcaagaatt

SEQ ID NO: 8349 - DNA, 23 bp, Artificial Sequence
  Synthetic
ccgttttttttttttgtgaattc

SEQ ID NO: 8350 - DNA, 23 bp, Artificial Sequence
  Synthetic
ccgttttttttttttcgcgcgct

SEQ ID NO: 8351 - DNA, 23 bp, Artificial Sequence
  Synthetic
ccgttttttttttttcgtaggaa

SEQ ID NO: 8352 - DNA, 23 bp, Artificial Sequence
  Synthetic
ccgttttttttttttgtcgtacc

SEQ ID NO: 8353 - DNA, 23 bp, Artificial Sequence
  Synthetic
ccgttttttttttttaaacggac

SEQ ID NO: 8354 - DNA, 23 bp, Artificial Sequence
  Synthetic
ccgttttttttttttaatgagtg

SEQ ID NO: 8355 - DNA, 23 bp, Artificial Sequence
  Synthetic
ccgttttttttttttataaagag

SEQ ID NO: 8356 - DNA, 23 bp, Artificial Sequence
  Synthetic
ccgttttttttttttacagacaa

SEQ ID NO: 8357 - DNA, 23 bp, Artificial Sequence
  Synthetic
ccgttttttttttttagaattac

SEQ ID NO: 8358 - DNA, 23 bp, Artificial Sequence
  Synthetic
ccgttttttttttttcagagcac

SEQ ID NO: 8359 - DNA, 23 bp, Artificial Sequence
  Synthetic
ccgttttttttttttctcactca

SEQ ID NO: 8360 - DNA, 23 bp, Artificial Sequence
  Synthetic
ccgttttttttttttctcacagt

SEQ ID NO: 8361 - DNA, 23 bp, Artificial Sequence
  Synthetic
ccgttttttttttttgctttctg

SEQ ID NO: 8362 - DNA, 23 bp, Artificial Sequence
  Synthetic
ccgttttttttttttactgagat

SEQ ID NO: 8363 - DNA, 23 bp, Artificial Sequence
  Synthetic
ccgttttttttttttacaacaaa

SEQ ID NO: 8364 - DNA, 23 bp, Artificial Sequence
  Synthetic
ccgttttttttttttatgctttg

SEQ ID NO: 8365 - DNA, 23 bp, Artificial Sequence
  Synthetic
ccgttttttttttttgacatctt

SEQ ID NO: 8366 - DNA, 23 bp, Artificial Sequence
  Synthetic
ccgttttttttttttataggccg

SEQ ID NO: 8367 - DNA, 23 bp, Artificial Sequence
  Synthetic
ccgttttttttttttgcaggccg

SEQ ID NO: 8368 - DNA, 23 bp, Artificial Sequence
  Synthetic
ccgttttttttttttcatacagc

SEQ ID NO: 8369 - DNA, 23 bp, Artificial Sequence
  Synthetic
ccgttttttttttttcatacagc

SEQ ID NO: 8370 - DNA, 23 bp, Artificial Sequence
  Synthetic
ccgttttttttttttctacagct

SEQ ID NO: 8371 - DNA, 23 bp, Artificial Sequence
  Synthetic
ccgttttttttttttcaggatac

SEQ ID NO: 8372 - DNA, 23 bp, Artificial Sequence
  Synthetic
ccgttttttttttttcacaagtt

SEQ ID NO: 8373 - DNA, 23 bp, Artificial Sequence
  Synthetic
ccgttttttttttttcttcagtt

SEQ ID NO: 8374 - DNA, 23 bp, Artificial Sequence
  Synthetic
ccgttttttttttttcatagccc

SEQ ID NO: 8375 - DNA, 23 bp, Artificial Sequence
  Synthetic
ccgttttttttttttgctacctg

SEQ ID NO: 8376 - DNA, 23 bp, Artificial Sequence
  Synthetic
ccgttttttttttttatctgcac

SEQ ID NO: 8377 - DNA, 23 bp, Artificial Sequence
  Synthetic
ccgttttttttttttcacaaatt

SEQ ID NO: 8378 - DNA, 23 bp, Artificial Sequence
  Synthetic
ccgttttttttttttggcattca

SEQ ID NO: 8379 - DNA, 23 bp, Artificial Sequence
  Synthetic
ccgttttttttttttcacaagtt

SEQ ID NO: 8380 - DNA, 23 bp, Artificial Sequence
  Synthetic
ccgttttttttttttagccaagc

SEQ ID NO: 8381 - DNA, 23 bp, Artificial Sequence
  Synthetic
ccgttttttttttttaaaagaga

SEQ ID NO: 8382 - DNA, 23 bp, Artificial Sequence
  Synthetic
ccgttttttttttttacagctgg

SEQ ID NO: 8383 - DNA, 23 bp, Artificial Sequence
  Synthetic
ccgttttttttttttcacatagg

SEQ ID NO: 8384 - DNA, 23 bp, Artificial Sequence
  Synthetic
ccgttttttttttttcacaaacc

SEQ ID NO: 8385 - DNA, 23 bp, Artificial Sequence
  Synthetic
ccgttttttttttttgtaaacca

SEQ ID NO: 8386 - DNA, 23 bp, Artificial Sequence
  Synthetic
ccgttttttttttttcgccaata

SEQ ID NO: 8387 - DNA, 23 bp, Artificial Sequence
  Synthetic
ccgttttttttttttacaagtgc

SEQ ID NO: 8388 - DNA, 23 bp, Artificial Sequence
  Synthetic
ccgttttttttttttactacctg

SEQ ID NO: 8389 - DNA, 23 bp, Artificial Sequence
  Synthetic
ccgttttttttttttatctgcac

SEQ ID NO: 8390 - DNA, 23 bp, Artificial Sequence
  Synthetic
ccgttttttttttttccacatgg

SEQ ID NO: 8391 - DNA, 23 bp, Artificial Sequence
  Synthetic
ccgttttttttttttcccaacaa

SEQ ID NO: 8392 - DNA, 23 bp, Artificial Sequence
  Synthetic
ccgttttttttttttgctgggtg

SEQ ID NO: 8393 - DNA, 23 bp, Artificial Sequence
  Synthetic
ccgttttttttttttcctagctc

SEQ ID NO: 8394 - DNA, 23 bp, Artificial Sequence
  Synthetic
ccgttttttttttttcagttttg

SEQ ID NO: 8395 - DNA, 23 bp, Artificial Sequence
  Synthetic
ccgttttttttttttcagttttg

SEQ ID NO: 8396 - DNA, 23 bp, Artificial Sequence
  Synthetic
ccgttttttttttttacctgcac

SEQ ID NO: 8397 - DNA, 23 bp, Artificial Sequence
  Synthetic
ccgttttttttttttcagactcc

SEQ ID NO: 8398 - DNA, 23 bp, Artificial Sequence
  Synthetic
ccgttttttttttttcaacatca

SEQ ID NO: 8399 - DNA, 23 bp, Artificial Sequence
  Synthetic
ccgttttttttttttctgcctgt

SEQ ID NO: 8400 - DNA, 23 bp, Artificial Sequence
  Synthetic
ccgttttttttttttacatggtt

SEQ ID NO: 8401 - DNA, 23 bp, Artificial Sequence
  Synthetic
ccgttttttttttttacagttct

SEQ ID NO: 8402 - DNA, 23 bp, Artificial Sequence
  Synthetic
ccgttttttttttttgagaccca

SEQ ID NO: 8403 - DNA, 23 bp, Artificial Sequence
  Synthetic
ccgttttttttttttggaaatcc

SEQ ID NO: 8404 - DNA, 23 bp, Artificial Sequence
  Synthetic
ccgttttttttttttggcggaac

SEQ ID NO: 8405 - DNA, 23 bp, Artificial Sequence
  Synthetic
ccgttttttttttttctcaatag

SEQ ID NO: 8406 - DNA, 23 bp, Artificial Sequence
  Synthetic
ccgttttttttttttaaccgatt

SEQ ID NO: 8407 - DNA, 23 bp, Artificial Sequence
  Synthetic
ccgttttttttttttactgattt

SEQ ID NO: 8408 - DNA, 23 bp, Artificial Sequence
  Synthetic
ccgttttttttttttgctgagtg

SEQ ID NO: 8409 - DNA, 23 bp, Artificial Sequence
  Synthetic
ccgttttttttttttacaaccag

SEQ ID NO: 8410 - DNA, 23 bp, Artificial Sequence
  Synthetic
ccgttttttttttttcatacagc

SEQ ID NO: 8411 - DNA, 23 bp, Artificial Sequence
  Synthetic
ccgttttttttttttacaggccg

SEQ ID NO: 8412 - DNA, 23 bp, Artificial Sequence
  Synthetic
ccgttttttttttttctacctgc

SEQ ID NO: 8413 - DNA, 23 bp, Artificial Sequence
  Synthetic
ccgttttttttttttaacaatac

SEQ ID NO: 8414 - DNA, 23 bp, Artificial Sequence
  Synthetic
ccgttttttttttttaatcagct

SEQ ID NO: 8415 - DNA, 23 bp, Artificial Sequence
  Synthetic
ccgttttttttttttctccatac

SEQ ID NO: 8416 - DNA, 23 bp, Artificial Sequence
  Synthetic
ccgttttttttttttaccagtac

SEQ ID NO: 8417 - DNA, 23 bp, Artificial Sequence
  Synthetic
ccgttttttttttttcttggcat

SEQ ID NO: 8418 - DNA, 23 bp, Artificial Sequence
  Synthetic
ccgttttttttttttcacaagtt

SEQ ID NO: 8419 - DNA, 23 bp, Artificial Sequence
  Synthetic
ccgttttttttttttacagctgg

SEQ ID NO: 8420 - DNA, 23 bp, Artificial Sequence
  Synthetic
ccgttttttttttttgcccttat

SEQ ID NO: 8421 - DNA, 23 bp, Artificial Sequence
  Synthetic
ccgttttttttttttgctcatca

SEQ ID NO: 8422 - DNA, 23 bp, Artificial Sequence
  Synthetic
ccgttttttttttttagccgctg

SEQ ID NO: 8423 - DNA, 23 bp, Artificial Sequence
  Synthetic
ccgttttttttttttcaagaatt

SEQ ID NO: 8424 - DNA, 23 bp, Artificial Sequence
  Synthetic
ccgttttttttttttgtgaattc

SEQ ID NO: 8425 - DNA, 23 bp, Artificial Sequence
  Synthetic
ccgttttttttttttagagcacg

SEQ ID NO: 8426 - DNA, 23 bp, Artificial Sequence
  Synthetic
ccgttttttttttttgtcgtacc

SEQ ID NO: 8427 - DNA, 23 bp, Artificial Sequence
  Synthetic
ccgttttttttttttaaacggac

SEQ ID NO: 8428 - DNA, 23 bp, Artificial Sequence
  Synthetic
ccgttttttttttttacaaagag

SEQ ID NO: 8429 - DNA, 23 bp, Artificial Sequence
  Synthetic
ccgttttttttttttacagacaa

SEQ ID NO: 8430 - DNA, 23 bp, Artificial Sequence
  Synthetic
ccgttttttttttttcagagcac

SEQ ID NO: 8431 - DNA, 23 bp, Artificial Sequence
  Synthetic
ccgttttttttttttgctttctg

SEQ ID NO: 8432 - DNA, 23 bp, Artificial Sequence
  Synthetic
ccgttttttttttttactgagat

SEQ ID NO: 8433 - DNA, 23 bp, Artificial Sequence
  Synthetic
ccgttttttttttttacaacaaa

SEQ ID NO: 8434 - DNA, 23 bp, Artificial Sequence
  Synthetic
ccgttttttttttttgacatctt

SEQ ID NO: 8435 - DNA, 23 bp, Artificial Sequence
  Synthetic
ccgttttttttttttcatacagc

SEQ ID NO: 8436 - DNA, 23 bp, Artificial Sequence
  Synthetic
ccgttttttttttttcataaagc

SEQ ID NO: 8437 - DNA, 23 bp, Artificial Sequence
  Synthetic
ccgttttttttttttcaggatac

SEQ ID NO: 8438 - DNA, 23 bp, Artificial Sequence
  Synthetic
ccgttttttttttttgtgctcac

SEQ ID NO: 8439 - DNA, 23 bp, Artificial Sequence
  Synthetic
ccgttttttttttttgtgctcac

SEQ ID NO: 8440 - DNA, 23 bp, Artificial Sequence
  Synthetic
ccgttttttttttttgtgctcac

SEQ ID NO: 8441 - DNA, 23 bp, Artificial Sequence
  Synthetic
ccgttttttttttttgtgctcac

SEQ ID NO: 8442 - DNA, 23 bp, Artificial Sequence
  Synthetic
ccgttttttttttttgtgctcac

SEQ ID NO: 8443 - DNA, 23 bp, Artificial Sequence
  Synthetic
ccgttttttttttttgtgctcac

SEQ ID NO: 8444 - DNA, 23 bp, Artificial Sequence
  Synthetic
ccgttttttttttttgtgctcac

SEQ ID NO: 8445 - DNA, 23 bp, Artificial Sequence
  Synthetic
ccgttttttttttttgtgctctc

SEQ ID NO: 8446 - DNA, 23 bp, Artificial Sequence
  Synthetic
ccgttttttttttttgtgctctc

SEQ ID NO: 8447 - DNA, 23 bp, Artificial Sequence
  Synthetic
ccgttttttttttttgtgctctc

SEQ ID NO: 8448 - DNA, 23 bp, Artificial Sequence
  Synthetic
ccgttttttttttttgtgctctc

SEQ ID NO: 8449 - DNA, 23 bp, Artificial Sequence
  Synthetic
ccgttttttttttttgtgctctc

SEQ ID NO: 8450 - DNA, 23 bp, Artificial Sequence
  Synthetic
ccgttttttttttttgctttgtc

SEQ ID NO: 8451 - DNA, 23 bp, Artificial Sequence
  Synthetic
ccgttttttttttttgctttgtc

SEQ ID NO: 8452 - DNA, 23 bp, Artificial Sequence
  Synthetic
ccgttttttttttttagagctcc

SEQ ID NO: 8453 - DNA, 23 bp, Artificial Sequence
  Synthetic
ccgttttttttttttaagagctc

SEQ ID NO: 8454 - DNA, 23 bp, Artificial Sequence
  Synthetic
ccgttttttttttttaggagctc

SEQ ID NO: 8455 - DNA, 23 bp, Artificial Sequence
  Synthetic
ccgttttttttttttggcataca

SEQ ID NO: 8456 - DNA, 23 bp, Artificial Sequence
  Synthetic
ccgttttttttttttggcataca

SEQ ID NO: 8457 - DNA, 23 bp, Artificial Sequence
  Synthetic
ccgttttttttttttggcataca

SEQ ID NO: 8458 - DNA, 23 bp, Artificial Sequence
  Synthetic
ccgttttttttttttccccgatg

SEQ ID NO: 8459 - DNA, 23 bp, Artificial Sequence
  Synthetic
ccgttttttttttttctggatgc

SEQ ID NO: 8460 - DNA, 23 bp, Artificial Sequence
  Synthetic
ccgttttttttttttctggatgc

SEQ ID NO: 8461 - DNA, 23 bp, Artificial Sequence
  Synthetic
ccgttttttttttttatcgaagt

SEQ ID NO: 8462 - DNA, 23 bp, Artificial Sequence
  Synthetic
ccgttttttttttttgcacgtgc

SEQ ID NO: 8463 - DNA, 23 bp, Artificial Sequence
  Synthetic
ccgttttttttttttgcacgtgc

SEQ ID NO: 8464 - DNA, 23 bp, Artificial Sequence
  Synthetic
ccgttttttttttttcgcacgtg

SEQ ID NO: 8465 - DNA, 23 bp, Artificial Sequence
  Synthetic
ccgttttttttttttgggggatg

SEQ ID NO: 8466 - DNA, 23 bp, Artificial Sequence
  Synthetic
ccgttttttttttttgggggatg

SEQ ID NO: 8467 - DNA, 23 bp, Artificial Sequence
  Synthetic
ccgttttttttttttggggaatg

SEQ ID NO: 8468 - DNA, 23 bp, Artificial Sequence
  Synthetic
ccgttttttttttttggggaatg

SEQ ID NO: 8469 - DNA, 23 bp, Artificial Sequence
  Synthetic
ccgttttttttttttggggaatg

SEQ ID NO: 8470 - DNA, 23 bp, Artificial Sequence
  Synthetic
ccgttttttttttttggggaatg

SEQ ID NO: 8471 - DNA, 23 bp, Artificial Sequence
  Synthetic
ccgttttttttttttggggaatg

SEQ ID NO: 8472 - DNA, 23 bp, Artificial Sequence
  Synthetic
ccgttttttttttttggggaatg

SEQ ID NO: 8473 - DNA, 23 bp, Artificial Sequence
  Synthetic
ccgttttttttttttggggaatg

SEQ ID NO: 8474 - DNA, 23 bp, Artificial Sequence
  Synthetic
ccgttttttttttttagatcatg

SEQ ID NO: 8475 - DNA, 23 bp, Artificial Sequence
  Synthetic
ccgttttttttttttagatcatg

SEQ ID NO: 8476 - DNA, 23 bp, Artificial Sequence
  Synthetic
ccgttttttttttttaagatcat

SEQ ID NO: 8477 - DNA, 23 bp, Artificial Sequence
  Synthetic
ccgttttttttttttccagatca

SEQ ID NO: 8478 - DNA, 23 bp, Artificial Sequence
  Synthetic
ccgttttttttttttcccgacct

SEQ ID NO: 8479 - DNA, 23 bp, Artificial Sequence
  Synthetic
ccgttttttttttttcccgacct

SEQ ID NO: 8480 - DNA, 23 bp, Artificial Sequence
  Synthetic
ccgttttttttttttcggcaagt

SEQ ID NO: 8481 - DNA, 23 bp, Artificial Sequence
  Synthetic
ccgttttttttttttccggcaag

SEQ ID NO: 8482 - DNA, 23 bp, Artificial Sequence
  Synthetic
ccgttttttttttttccggcaag

SEQ ID NO: 8483 - DNA, 23 bp, Artificial Sequence
  Synthetic
ccgttttttttttttcggcaagt

SEQ ID NO: 8484 - DNA, 23 bp, Artificial Sequence
  Synthetic
ccgttttttttttttcggcaagt

SEQ ID NO: 8485 - DNA, 23 bp, Artificial Sequence
  Synthetic
ccgttttttttttttcggcaagt

SEQ ID NO: 8486 - DNA, 23 bp, Artificial Sequence
  Synthetic
ccgttttttttttttcggcaagt

SEQ ID NO: 8487 - DNA, 23 bp, Artificial Sequence
  Synthetic
ccgttttttttttttagccaagg

SEQ ID NO: 8488 - DNA, 23 bp, Artificial Sequence
  Synthetic
ccgttttttttttttcaggcaag

SEQ ID NO: 8489 - DNA, 23 bp, Artificial Sequence
  Synthetic
ccgttttttttttttcaggcaag

SEQ ID NO: 8490 - DNA, 23 bp, Artificial Sequence
  Synthetic
ccgttttttttttttcaggcaag

SEQ ID NO: 8491 - DNA, 23 bp, Artificial Sequence
  Synthetic
ccgttttttttttttcaggcaag

SEQ ID NO: 8492 - DNA, 23 bp, Artificial Sequence
  Synthetic
ccgttttttttttttcaggcaag

SEQ ID NO: 8493 - DNA, 23 bp, Artificial Sequence
  Synthetic
ccgttttttttttttcaggcaag

SEQ ID NO: 8494 - DNA, 23 bp, Artificial Sequence
  Synthetic
ccgttttttttttttcaggcaag

SEQ ID NO: 8495 - DNA, 23 bp, Artificial Sequence
  Synthetic
ccgttttttttttttgatattga

SEQ ID NO: 8496 - DNA, 23 bp, Artificial Sequence
  Synthetic
ccgttttttttttttgatattgg

SEQ ID NO: 8497 - DNA, 23 bp, Artificial Sequence
  Synthetic
ccgttttttttttttcgtgatat

SEQ ID NO: 8498 - DNA, 23 bp, Artificial Sequence
  Synthetic
ccgttttttttttttcgtgatat

SEQ ID NO: 8499 - DNA, 23 bp, Artificial Sequence
  Synthetic
ccgttttttttttttatgcagca

SEQ ID NO: 8500 - DNA, 23 bp, Artificial Sequence
  Synthetic
ccgttttttttttttatgcagca

SEQ ID NO: 8501 - DNA, 23 bp, Artificial Sequence
  Synthetic
ccgttttttttttttgtgaatct

SEQ ID NO: 8502 - DNA, 23 bp, Artificial Sequence
  Synthetic
ccgttttttttttttctgcagca

SEQ ID NO: 8503 - DNA, 23 bp, Artificial Sequence
  Synthetic
ccgttttttttttttctgcagca

SEQ ID NO: 8504 - DNA, 23 bp, Artificial Sequence
  Synthetic
ccgttttttttttttatgcagca

SEQ ID NO: 8505 - DNA, 23 bp, Artificial Sequence
  Synthetic
ccgttttttttttttgtgatttc

SEQ ID NO: 8506 - DNA, 23 bp, Artificial Sequence
  Synthetic
ccgttttttttttttgggagctc

SEQ ID NO: 8507 - DNA, 23 bp, Artificial Sequence
  Synthetic
ccgttttttttttttgggagctc

SEQ ID NO: 8508 - DNA, 23 bp, Artificial Sequence
  Synthetic
ccgttttttttttttaggagctc

SEQ ID NO: 8509 - DNA, 23 bp, Artificial Sequence
  Synthetic
ccgttttttttttttggcgctat

SEQ ID NO: 8510 - DNA, 23 bp, Artificial Sequence
  Synthetic
ccgttttttttttttggcgctat

SEQ ID NO: 8511 - DNA, 23 bp, Artificial Sequence
  Synthetic
ccgttttttttttttggcgctat

SEQ ID NO: 8512 - DNA, 23 bp, Artificial Sequence
  Synthetic
ccgttttttttttttgatcaatg

SEQ ID NO: 8513 - DNA, 23 bp, Artificial Sequence
  Synthetic
ccgttttttttttttgatcaatg

SEQ ID NO: 8514 - DNA, 23 bp, Artificial Sequence
  Synthetic
ccgttttttttttttggaggtgg

SEQ ID NO: 8515 - DNA, 23 bp, Artificial Sequence
  Synthetic
ccgttttttttttttggaggtgg

SEQ ID NO: 8516 - DNA, 23 bp, Artificial Sequence
  Synthetic
ccgttttttttttttgagttccc

SEQ ID NO: 8517 - DNA, 23 bp, Artificial Sequence
  Synthetic
ccgttttttttttttgagtcccc

SEQ ID NO: 8518 - DNA, 23 bp, Artificial Sequence
  Synthetic
ccgttttttttttttgagtcccc

SEQ ID NO: 8519 - DNA, 23 bp, Artificial Sequence
  Synthetic
ccgttttttttttttgagttccc

SEQ ID NO: 8520 - DNA, 23 bp, Artificial Sequence
  Synthetic
ccgttttttttttttgagttccc

SEQ ID NO: 8521 - DNA, 23 bp, Artificial Sequence
  Synthetic
ccgttttttttttttgagtcccc

SEQ ID NO: 8522 - DNA, 23 bp, Artificial Sequence
  Synthetic
ccgttttttttttttcagttcaa

SEQ ID NO: 8523 - DNA, 23 bp, Artificial Sequence
  Synthetic
ccgttttttttttttaagttcaa

SEQ ID NO: 8524 - DNA, 23 bp, Artificial Sequence
  Synthetic
ccgttttttttttttcatcaacg

SEQ ID NO: 8525 - DNA, 23 bp, Artificial Sequence
  Synthetic
ccgttttttttttttcatcaacg

SEQ ID NO: 8526 - DNA, 23 bp, Artificial Sequence
  Synthetic
ccgttttttttttttaaggggtg

SEQ ID NO: 8527 - DNA, 23 bp, Artificial Sequence
  Synthetic
ccgttttttttttttcaggggtg

SEQ ID NO: 8528 - DNA, 23 bp, Artificial Sequence
  Synthetic
ccgttttttttttttcaggggtg

SEQ ID NO: 8529 - DNA, 23 bp, Artificial Sequence
  Synthetic
ccgttttttttttttcagggcaa

SEQ ID NO: 8530 - DNA, 23 bp, Artificial Sequence
  Synthetic
ccgttttttttttttcagggcaa

SEQ ID NO: 8531 - DNA, 23 bp, Artificial Sequence
  Synthetic
ccgttttttttttttcagggcaa

SEQ ID NO: 8532 - DNA, 23 bp, Artificial Sequence
  Synthetic
ccgttttttttttttcggggcaa

SEQ ID NO: 8533 - DNA, 23 bp, Artificial Sequence
  Synthetic
ccgttttttttttttcgaggcaa

SEQ ID NO: 8534 - DNA, 23 bp, Artificial Sequence
  Synthetic
ccgttttttttttttccgggcaa

SEQ ID NO: 8535 - DNA, 23 bp, Artificial Sequence
  Synthetic
ccgttttttttttttgtgactta

SEQ ID NO: 8536 - DNA, 23 bp, Artificial Sequence
  Synthetic
ccgttttttttttttgtcggtcg

SEQ ID NO: 8537 - DNA, 23 bp, Artificial Sequence
  Synthetic
ccgttttttttttttcagaggtt

SEQ ID NO: 8538 - DNA, 23 bp, Artificial Sequence
  Synthetic
ccgttttttttttttcgagtttg

SEQ ID NO: 8539 - DNA, 23 bp, Artificial Sequence
  Synthetic
ccgttttttttttttgctgccgc

SEQ ID NO: 8540 - DNA, 23 bp, Artificial Sequence
  Synthetic
ccgttttttttttttagttatgg

SEQ ID NO: 8541 - DNA, 23 bp, Artificial Sequence
  Synthetic
ccgttttttttttttagttatgg

SEQ ID NO: 8542 - DNA, 23 bp, Artificial Sequence
  Synthetic
ccgttttttttttttagttatgg

SEQ ID NO: 8543 - DNA, 23 bp, Artificial Sequence
  Synthetic
ccgttttttttttttctggatta

SEQ ID NO: 8544 - DNA, 23 bp, Artificial Sequence
  Synthetic
ccgttttttttttttaccaaaag

SEQ ID NO: 8545 - DNA, 23 bp, Artificial Sequence
  Synthetic
ccgttttttttttttgccaggga

SEQ ID NO: 8546 - DNA, 23 bp, Artificial Sequence
  Synthetic
ccgttttttttttttgtgcagaa

SEQ ID NO: 8547 - DNA, 23 bp, Artificial Sequence
  Synthetic
ccgttttttttttttgacgatga

SEQ ID NO: 8548 - DNA, 23 bp, Artificial Sequence
  Synthetic
ccgttttttttttttatgttctg

SEQ ID NO: 8549 - DNA, 23 bp, Artificial Sequence
  Synthetic
ccgttttttttttttgaacagtg

SEQ ID NO: 8550 - DNA, 23 bp, Artificial Sequence
  Synthetic
ccgttttttttttttcgaacaaa

SEQ ID NO: 8551 - DNA, 23 bp, Artificial Sequence
  Synthetic
ccgttttttttttttggtcagtt

SEQ ID NO: 8552 - DNA, 23 bp, Artificial Sequence
  Synthetic
ccgttttttttttttcaacatcc

SEQ ID NO: 8553 - DNA, 23 bp, Artificial Sequence
  Synthetic
ccgttttttttttttgcatttcc

SEQ ID NO: 8554 - DNA, 23 bp, Artificial Sequence
  Synthetic
ccgttttttttttttcgtaagga

SEQ ID NO: 8555 - DNA, 23 bp, Artificial Sequence
  Synthetic
ccgttttttttttttcaacaaaa

SEQ ID NO: 8556 - DNA, 23 bp, Artificial Sequence
  Synthetic
ccgttttttttttttcaacaaaa

SEQ ID NO: 8557 - DNA, 23 bp, Artificial Sequence
  Synthetic
ccgttttttttttttcaacaaaa

SEQ ID NO: 8558 - DNA, 23 bp, Artificial Sequence
  Synthetic
ccgttttttttttttgagggcta

SEQ ID NO: 8559 - DNA, 23 bp, Artificial Sequence
  Synthetic
ccgttttttttttttgtatgggc

SEQ ID NO: 8560 - DNA, 23 bp, Artificial Sequence
  Synthetic
ccgttttttttttttgagacaaa

SEQ ID NO: 8561 - DNA, 23 bp, Artificial Sequence
  Synthetic
ccgttttttttttttgatggcca

SEQ ID NO: 8562 - DNA, 23 bp, Artificial Sequence
  Synthetic
ccgttttttttttttggcactgc

SEQ ID NO: 8563 - DNA, 23 bp, Artificial Sequence
  Synthetic
ccgttttttttttttaacatcaa

SEQ ID NO: 8564 - DNA, 23 bp, Artificial Sequence
  Synthetic
ccgttttttttttttagcaacga

SEQ ID NO: 8565 - DNA, 23 bp, Artificial Sequence
  Synthetic
ccgttttttttttttcggtgtac

SEQ ID NO: 8566 - DNA, 23 bp, Artificial Sequence
  Synthetic
ccgttttttttttttatgagcag

SEQ ID NO: 8567 - DNA, 23 bp, Artificial Sequence
  Synthetic
ccgttttttttttttgccagata

SEQ ID NO: 8568 - DNA, 23 bp, Artificial Sequence
  Synthetic
ccgttttttttttttaagtatcc

SEQ ID NO: 8569 - DNA, 23 bp, Artificial Sequence
  Synthetic
ccgttttttttttttaagaacat

SEQ ID NO: 8570 - DNA, 23 bp, Artificial Sequence
  Synthetic
ccgttttttttttttgaacatga

SEQ ID NO: 8571 - DNA, 23 bp, Artificial Sequence
  Synthetic
ccgttttttttttttactataca

SEQ ID NO: 8572 - DNA, 23 bp, Artificial Sequence
  Synthetic
ccgttttttttttttctccatac

SEQ ID NO: 8573 - DNA, 23 bp, Artificial Sequence
  Synthetic
ccgttttttttttttacaaattc

SEQ ID NO: 8574 - DNA, 23 bp, Artificial Sequence
  Synthetic
ccgttttttttttttcttggcat

SEQ ID NO: 8575 - DNA, 23 bp, Artificial Sequence
  Synthetic
ccgttttttttttttaggagaga

SEQ ID NO: 8576 - DNA, 23 bp, Artificial Sequence
  Synthetic
ccgttttttttttttgtgaattc

SEQ ID NO: 8577 - DNA, 23 bp, Artificial Sequence
  Synthetic
ccgttttttttttttgtgaattc

SEQ ID NO: 8578 - DNA, 23 bp, Artificial Sequence
  Synthetic
ccgttttttttttttcgcgcgct

SEQ ID NO: 8579 - DNA, 23 bp, Artificial Sequence
  Synthetic
ccgttttttttttttcgtaggaa

SEQ ID NO: 8580 - DNA, 23 bp, Artificial Sequence
  Synthetic
ccgttttttttttttgtcgtacc

SEQ ID NO: 8581 - DNA, 23 bp, Artificial Sequence
  Synthetic
ccgttttttttttttatgagtgt

SEQ ID NO: 8582 - DNA, 23 bp, Artificial Sequence
  Synthetic
ccgttttttttttttacagacaa

SEQ ID NO: 8583 - DNA, 23 bp, Artificial Sequence
  Synthetic
ccgttttttttttttagaattac

SEQ ID NO: 8584 - DNA, 23 bp, Artificial Sequence
  Synthetic
ccgttttttttttttcagagcac

SEQ ID NO: 8585 - DNA, 23 bp, Artificial Sequence
  Synthetic
ccgttttttttttttctcactca

SEQ ID NO: 8586 - DNA, 23 bp, Artificial Sequence
  Synthetic
ccgttttttttttttcagctatg

SEQ ID NO: 8587 - DNA, 23 bp, Artificial Sequence
  Synthetic
ccgttttttttttttcaaccagc

SEQ ID NO: 8588 - DNA, 23 bp, Artificial Sequence
  Synthetic
ccgttttttttttttacaacaaa

SEQ ID NO: 8589 - DNA, 23 bp, Artificial Sequence
  Synthetic
ccgttttttttttttcactaccc

SEQ ID NO: 8590 - DNA, 23 bp, Artificial Sequence
  Synthetic
ccgttttttttttttgacatctt

SEQ ID NO: 8591 - DNA, 23 bp, Artificial Sequence
  Synthetic
ccgttttttttttttcatacagc

SEQ ID NO: 8592 - DNA, 23 bp, Artificial Sequence
  Synthetic
ccgttttttttttttaactatac

SEQ ID NO: 8593 - DNA, 23 bp, Artificial Sequence
  Synthetic
ccgttttttttttttaactatgc

SEQ ID NO: 8594 - DNA, 23 bp, Artificial Sequence
  Synthetic
ccgttttttttttttaactatac

SEQ ID NO: 8595 - DNA, 23 bp, Artificial Sequence
  Synthetic
ccgttttttttttttaactgtac

SEQ ID NO: 8596 - DNA, 23 bp, Artificial Sequence
  Synthetic
ccgttttttttttttaacagcac

SEQ ID NO: 8597 - DNA, 23 bp, Artificial Sequence
  Synthetic
ccgttttttttttttcagttatc

SEQ ID NO: 8598 - DNA, 23 bp, Artificial Sequence
  Synthetic
ccgttttttttttttcatagccc

SEQ ID NO: 8599 - DNA, 23 bp, Artificial Sequence
  Synthetic
ccgttttttttttttacctgcac

SEQ ID NO: 8600 - DNA, 23 bp, Artificial Sequence
  Synthetic
ccgttttttttttttgatagccc

SEQ ID NO: 8601 - DNA, 23 bp, Artificial Sequence
  Synthetic
ccgttttttttttttcacaaatt

SEQ ID NO: 8602 - DNA, 23 bp, Artificial Sequence
  Synthetic
ccgttttttttttttcacaaatt

SEQ ID NO: 8603 - DNA, 23 bp, Artificial Sequence
  Synthetic
ccgttttttttttttcaaacacc

SEQ ID NO: 8604 - DNA, 23 bp, Artificial Sequence
  Synthetic
ccgttttttttttttggcattca

SEQ ID NO: 8605 - DNA, 23 bp, Artificial Sequence
  Synthetic
ccgttttttttttttcacaggtt

SEQ ID NO: 8606 - DNA, 23 bp, Artificial Sequence
  Synthetic
ccgttttttttttttcacaagtt

SEQ ID NO: 8607 - DNA, 23 bp, Artificial Sequence
  Synthetic
ccgttttttttttttcgcattat

SEQ ID NO: 8608 - DNA, 23 bp, Artificial Sequence
  Synthetic
ccgttttttttttttagccaagc

SEQ ID NO: 8609 - DNA, 23 bp, Artificial Sequence
  Synthetic
ccgttttttttttttaaaagaga

SEQ ID NO: 8610 - DNA, 23 bp, Artificial Sequence
  Synthetic
ccgttttttttttttcgaccatg

SEQ ID NO: 8611 - DNA, 23 bp, Artificial Sequence
  Synthetic
ccgttttttttttttcggcctga

SEQ ID NO: 8612 - DNA, 23 bp, Artificial Sequence
  Synthetic
ccgttttttttttttactggaga

SEQ ID NO: 8613 - DNA, 23 bp, Artificial Sequence
  Synthetic
ccgttttttttttttccgtggtt

SEQ ID NO: 8614 - DNA, 23 bp, Artificial Sequence
  Synthetic
ccgttttttttttttgtagtgct

SEQ ID NO: 8615 - DNA, 23 bp, Artificial Sequence
  Synthetic
ccgttttttttttttcatccata

SEQ ID NO: 8616 - DNA, 23 bp, Artificial Sequence
  Synthetic
ccgttttttttttttagggattc

SEQ ID NO: 8617 - DNA, 23 bp, Artificial Sequence
  Synthetic
ccgttttttttttttacaaagtt

SEQ ID NO: 8618 - DNA, 23 bp, Artificial Sequence
  Synthetic
ccgttttttttttttacaaagtt

SEQ ID NO: 8619 - DNA, 23 bp, Artificial Sequence
  Synthetic
ccgttttttttttttacactggt

SEQ ID NO: 8620 - DNA, 23 bp, Artificial Sequence
  Synthetic
ccgttttttttttttcctcaagg

SEQ ID NO: 8621 - DNA, 23 bp, Artificial Sequence
  Synthetic
ccgttttttttttttactagact

SEQ ID NO: 8622 - DNA, 23 bp, Artificial Sequence
  Synthetic
ccgttttttttttttgtaaacca

SEQ ID NO: 8623 - DNA, 23 bp, Artificial Sequence
  Synthetic
ccgttttttttttttgccaatat

SEQ ID NO: 8624 - DNA, 23 bp, Artificial Sequence
  Synthetic
ccgttttttttttttacaagtgc

SEQ ID NO: 8625 - DNA, 23 bp, Artificial Sequence
  Synthetic
ccgttttttttttttactacctg

SEQ ID NO: 8626 - DNA, 23 bp, Artificial Sequence
  Synthetic
ccgttttttttttttaactcacc

SEQ ID NO: 8627 - DNA, 23 bp, Artificial Sequence
  Synthetic
ccgttttttttttttaaacccac

SEQ ID NO: 8628 - DNA, 23 bp, Artificial Sequence
  Synthetic
ccgttttttttttttaaactcac

SEQ ID NO: 8629 - DNA, 23 bp, Artificial Sequence
  Synthetic
ccgttttttttttttagcccaaa

SEQ ID NO: 8630 - DNA, 23 bp, Artificial Sequence
  Synthetic
ccgttttttttttttatctgcac

SEQ ID NO: 8631 - DNA, 23 bp, Artificial Sequence
  Synthetic
ccgttttttttttttaactgcac

SEQ ID NO: 8632 - DNA, 23 bp, Artificial Sequence
  Synthetic
ccgttttttttttttcagctgct

SEQ ID NO: 8633 - DNA, 23 bp, Artificial Sequence
  Synthetic
ccgttttttttttttctggctgt

SEQ ID NO: 8634 - DNA, 23 bp, Artificial Sequence
  Synthetic
ccgttttttttttttactgggac

SEQ ID NO: 8635 - DNA, 23 bp, Artificial Sequence
  Synthetic
ccgttttttttttttcatctcgc

SEQ ID NO: 8636 - DNA, 23 bp, Artificial Sequence
  Synthetic
ccgttttttttttttaacaggta

SEQ ID NO: 8637 - DNA, 23 bp, Artificial Sequence
  Synthetic
ccgttttttttttttaaccaatg

SEQ ID NO: 8638 - DNA, 23 bp, Artificial Sequence
  Synthetic
ccgttttttttttttgaacagat

SEQ ID NO: 8639 - DNA, 23 bp, Artificial Sequence
  Synthetic
ccgttttttttttttaacatcgt

SEQ ID NO: 8640 - DNA, 23 bp, Artificial Sequence
  Synthetic
ccgttttttttttttcatcatta

SEQ ID NO: 8641 - DNA, 23 bp, Artificial Sequence
  Synthetic
ccgttttttttttttccatcatt

SEQ ID NO: 8642 - DNA, 23 bp, Artificial Sequence
  Synthetic
ccgttttttttttttcagactcc

SEQ ID NO: 8643 - DNA, 23 bp, Artificial Sequence
  Synthetic
ccgttttttttttttctacctgc

SEQ ID NO: 8644 - DNA, 23 bp, Artificial Sequence
  Synthetic
ccgttttttttttttacctgcac

SEQ ID NO: 8645 - DNA, 23 bp, Artificial Sequence
  Synthetic
ccgttttttttttttagtcaaca

SEQ ID NO: 8646 - DNA, 23 bp, Artificial Sequence
  Synthetic
ccgttttttttttttagacagcc

SEQ ID NO: 8647 - DNA, 23 bp, Artificial Sequence
  Synthetic
ccgttttttttttttcagccgct

SEQ ID NO: 8648 - DNA, 23 bp, Artificial Sequence
  Synthetic
ccgttttttttttttactgcctg

SEQ ID NO: 8649 - DNA, 23 bp, Artificial Sequence
  Synthetic
ccgttttttttttttgtctgtca

SEQ ID NO: 8650 - DNA, 23 bp, Artificial Sequence
  Synthetic
ccgttttttttttttacatggtt

SEQ ID NO: 8651 - DNA, 23 bp, Artificial Sequence
  Synthetic
ccgttttttttttttaaagcttg

SEQ ID NO: 8652 - DNA, 23 bp, Artificial Sequence
  Synthetic
ccgttttttttttttaaacccag

SEQ ID NO: 8653 - DNA, 23 bp, Artificial Sequence
  Synthetic
ccgttttttttttttacccagta

SEQ ID NO: 8654 - DNA, 23 bp, Artificial Sequence
  Synthetic
ccgttttttttttttggaaatcc

SEQ ID NO: 8655 - DNA, 23 bp, Artificial Sequence
  Synthetic
ccgttttttttttttgtggtaat

SEQ ID NO: 8656 - DNA, 23 bp, Artificial Sequence
  Synthetic
ccgttttttttttttctgttcct

SEQ ID NO: 8657 - DNA, 23 bp, Artificial Sequence
  Synthetic
ccgttttttttttttcagaccga

SEQ ID NO: 8658 - DNA, 23 bp, Artificial Sequence
  Synthetic
ccgttttttttttttagcctatc

SEQ ID NO: 8659 - DNA, 23 bp, Artificial Sequence
  Synthetic
ccgttttttttttttaacctatc

SEQ ID NO: 8660 - DNA, 23 bp, Artificial Sequence
  Synthetic
ccgttttttttttttcggaactt

SEQ ID NO: 8661 - DNA, 23 bp, Artificial Sequence
  Synthetic
ccgttttttttttttgcagaact

SEQ ID NO: 8662 - DNA, 23 bp, Artificial Sequence
  Synthetic
ccgttttttttttttaaccgatt

SEQ ID NO: 8663 - DNA, 23 bp, Artificial Sequence
  Synthetic
ccgttttttttttttaaacactg

SEQ ID NO: 8664 - DNA, 23 bp, Artificial Sequence
  Synthetic
ccgttttttttttttaaccgatt

SEQ ID NO: 8665 - DNA, 23 bp, Artificial Sequence
  Synthetic
ccgttttttttttttagcttcca

SEQ ID NO: 8666 - DNA, 23 bp, Artificial Sequence
  Synthetic
ccgttttttttttttagctgagt

SEQ ID NO: 8667 - DNA, 23 bp, Artificial Sequence
  Synthetic
ccgttttttttttttgctgagag

SEQ ID NO: 8668 - DNA, 23 bp, Artificial Sequence
  Synthetic
ccgttttttttttttagcttcca

SEQ ID NO: 8669 - DNA, 23 bp, Artificial Sequence
  Synthetic
ccgttttttttttttagcttcca

SEQ ID NO: 8670 - DNA, 23 bp, Artificial Sequence
  Synthetic
ccgttttttttttttagctatgc

SEQ ID NO: 8671 - DNA, 23 bp, Artificial Sequence
  Synthetic
ccgttttttttttttcgccctct

SEQ ID NO: 8672 - DNA, 23 bp, Artificial Sequence
  Synthetic
ccgttttttttttttagatgggt

SEQ ID NO: 8673 - DNA, 23 bp, Artificial Sequence
  Synthetic
ccgttttttttttttagcactgg

SEQ ID NO: 8674 - DNA, 23 bp, Artificial Sequence
  Synthetic
ccgttttttttttttcaatcagc

SEQ ID NO: 8675 - DNA, 23 bp, Artificial Sequence
  Synthetic
ccgttttttttttttcaatcagc

SEQ ID NO: 8676 - DNA, 23 bp, Artificial Sequence
  Synthetic
ccgttttttttttttgtacccct

SEQ ID NO: 8677 - DNA, 23 bp, Artificial Sequence
  Synthetic
ccgttttttttttttcgcagatg

SEQ ID NO: 8678 - DNA, 23 bp, Artificial Sequence
  Synthetic
ccgttttttttttttaaagatca

SEQ ID NO: 8679 - DNA, 23 bp, Artificial Sequence
  Synthetic
ccgttttttttttttgcgaatat

SEQ ID NO: 8680 - DNA, 23 bp, Artificial Sequence
  Synthetic
ccgttttttttttttagacgtgg

SEQ ID NO: 8681 - DNA, 23 bp, Artificial Sequence
  Synthetic
ccgttttttttttttgcgcatgt

SEQ ID NO: 8682 - DNA, 23 bp, Artificial Sequence
  Synthetic
ccgttttttttttttactgaggg

SEQ ID NO: 8683 - DNA, 23 bp, Artificial Sequence
  Synthetic
ccgttttttttttttgggcggac

SEQ ID NO: 8684 - DNA, 23 bp, Artificial Sequence
  Synthetic
ccgttttttttttttcaacggga

SEQ ID NO: 8685 - DNA, 23 bp, Artificial Sequence
  Synthetic
ccgttttttttttttatattagg

SEQ ID NO: 8686 - DNA, 23 bp, Artificial Sequence
  Synthetic
ccgttttttttttttgatgtagt

SEQ ID NO: 8687 - DNA, 23 bp, Artificial Sequence
  Synthetic
ccgttttttttttttagtgtata

SEQ ID NO: 8688 - DNA, 23 bp, Artificial Sequence
  Synthetic
ccgttttttttttttatcgggag

SEQ ID NO: 8689 - DNA, 23 bp, Artificial Sequence
  Synthetic
ccgttttttttttttactggatg

SEQ ID NO: 8690 - DNA, 23 bp, Artificial Sequence
  Synthetic
ccgttttttttttttaagtggat

SEQ ID NO: 8691 - DNA, 23 bp, Artificial Sequence
  Synthetic
ccgttttttttttttaaacatca

SEQ ID NO: 8692 - DNA, 23 bp, Artificial Sequence
  Synthetic
ccgttttttttttttacggtcct

SEQ ID NO: 8693 - DNA, 23 bp, Artificial Sequence
  Synthetic
ccgttttttttttttcatccaat

SEQ ID NO: 8694 - DNA, 23 bp, Artificial Sequence
  Synthetic
ccgttttttttttttcacacaat

SEQ ID NO: 8695 - DNA, 23 bp, Artificial Sequence
  Synthetic
ccgttttttttttttaacaacaa

SEQ ID NO: 8696 - DNA, 23 bp, Artificial Sequence
  Synthetic
ccgttttttttttttacaggccg

SEQ ID NO: 8697 - DNA, 23 bp, Artificial Sequence
  Synthetic
ccgttttttttttttacctgcac

SEQ ID NO: 8698 - DNA, 23 bp, Artificial Sequence
  Synthetic
ccgttttttttttttaacaatac

SEQ ID NO: 8699 - DNA, 23 bp, Artificial Sequence
  Synthetic
ccgttttttttttttacaagatc

SEQ ID NO: 8700 - DNA, 23 bp, Artificial Sequence
  Synthetic
ccgttttttttttttaactatac

SEQ ID NO: 8701 - DNA, 23 bp, Artificial Sequence
  Synthetic
ccgttttttttttttcacacttg

SEQ ID NO: 8702 - DNA, 23 bp, Artificial Sequence
  Synthetic
ccgttttttttttttcggaatgc

SEQ ID NO: 8703 - DNA, 23 bp, Artificial Sequence
  Synthetic
ccgttttttttttttacatactt

SEQ ID NO: 8704 - DNA, 23 bp, Artificial Sequence
  Synthetic
ccgttttttttttttggcattca

SEQ ID NO: 8705 - DNA, 23 bp, Artificial Sequence
  Synthetic
ccgttttttttttttccgtgaat

SEQ ID NO: 8706 - DNA, 23 bp, Artificial Sequence
  Synthetic
ccgttttttttttttcctggtcg

SEQ ID NO: 8707 - DNA, 23 bp, Artificial Sequence
  Synthetic
ccgttttttttttttcctgcctg

SEQ ID NO: 8708 - DNA, 23 bp, Artificial Sequence
  Synthetic
ccgttttttttttttcaccgcag

SEQ ID NO: 8709 - DNA, 23 bp, Artificial Sequence
  Synthetic
ccgttttttttttttcccgcaca

SEQ ID NO: 8710 - DNA, 23 bp, Artificial Sequence
  Synthetic
ccgttttttttttttaagggtat

SEQ ID NO: 8711 - DNA, 23 bp, Artificial Sequence
  Synthetic
ccgttttttttttttagcgtcat

SEQ ID NO: 8712 - DNA, 23 bp, Artificial Sequence
  Synthetic
ccgttttttttttttccagtacc

SEQ ID NO: 8713 - DNA, 23 bp, Artificial Sequence
  Synthetic
ccgttttttttttttcagtactt

SEQ ID NO: 8714 - DNA, 23 bp, Artificial Sequence
  Synthetic
ccgttttttttttttagcgaaaa

SEQ ID NO: 8715 - DNA, 23 bp, Artificial Sequence
  Synthetic
ccgttttttttttttcatttctc

SEQ ID NO: 8716 - DNA, 23 bp, Artificial Sequence
  Synthetic
ccgttttttttttttcataccac

SEQ ID NO: 8717 - DNA, 23 bp, Artificial Sequence
  Synthetic
ccgttttttttttttgagctact

SEQ ID NO: 8718 - DNA, 23 bp, Artificial Sequence
  Synthetic
ccgttttttttttttagctccta

SEQ ID NO: 8719 - DNA, 23 bp, Artificial Sequence
  Synthetic
ccgttttttttttttgagcgtta

SEQ ID NO: 8720 - DNA, 23 bp, Artificial Sequence
  Synthetic
ccgttttttttttttgcaacact

SEQ ID NO: 8721 - DNA, 23 bp, Artificial Sequence
  Synthetic
ccgttttttttttttccgtgcca

SEQ ID NO: 8722 - DNA, 23 bp, Artificial Sequence
  Synthetic
ccgttttttttttttaataagag

SEQ ID NO: 8723 - DNA, 23 bp, Artificial Sequence
  Synthetic
ccgttttttttttttgttacctg

SEQ ID NO: 8724 - DNA, 23 bp, Artificial Sequence
  Synthetic
ccgttttttttttttagttagtg

SEQ ID NO: 8725 - DNA, 23 bp, Artificial Sequence
  Synthetic
ccgttttttttttttatacagtt

SEQ ID NO: 8726 - DNA, 23 bp, Artificial Sequence
  Synthetic
ccgttttttttttttaaccagat

SEQ ID NO: 8727 - DNA, 23 bp, Artificial Sequence
  Synthetic
ccgttttttttttttaccaaaac

SEQ ID NO: 8728 - DNA, 23 bp, Artificial Sequence
  Synthetic
ccgttttttttttttcaaccagc

SEQ ID NO: 8729 - DNA, 23 bp, Artificial Sequence
  Synthetic
ccgttttttttttttcttgcaag

SEQ ID NO: 8730 - DNA, 23 bp, Artificial Sequence
  Synthetic
ccgttttttttttttgataccaa

SEQ ID NO: 8731 - DNA, 23 bp, Artificial Sequence
  Synthetic
ccgttttttttttttaggagcag

SEQ ID NO: 8732 - DNA, 23 bp, Artificial Sequence
  Synthetic
ccgttttttttttttcatagctc

SEQ ID NO: 8733 - DNA, 23 bp, Artificial Sequence
  Synthetic
ccgttttttttttttggatttgt

SEQ ID NO: 8734 - DNA, 23 bp, Artificial Sequence
  Synthetic
ccgttttttttttttccgtcaat

SEQ ID NO: 8735 - DNA, 23 bp, Artificial Sequence
  Synthetic
ccgttttttttttttccacgact

SEQ ID NO: 8736 - DNA, 23 bp, Artificial Sequence
  Synthetic
ccgttttttttttttattgcgaa

SEQ ID NO: 8737 - DNA, 23 bp, Artificial Sequence
  Synthetic
ccgttttttttttttgtgaacgg

SEQ ID NO: 8738 - DNA, 23 bp, Artificial Sequence
  Synthetic
ccgttttttttttttataccagg

SEQ ID NO: 8739 - DNA, 23 bp, Artificial Sequence
  Synthetic
ccgttttttttttttctaaccgt

SEQ ID NO: 8740 - DNA, 23 bp, Artificial Sequence
  Synthetic
ccgttttttttttttctagctga

SEQ ID NO: 8741 - DNA, 23 bp, Artificial Sequence
  Synthetic
ccgttttttttttttgggagttt

SEQ ID NO: 8742 - DNA, 23 bp, Artificial Sequence
  Synthetic
ccgttttttttttttctgtagat

SEQ ID NO: 8743 - DNA, 23 bp, Artificial Sequence
  Synthetic
ccgttttttttttttgcgacagc

SEQ ID NO: 8744 - DNA, 23 bp, Artificial Sequence
  Synthetic
ccgttttttttttttagctgaat

SEQ ID NO: 8745 - DNA, 23 bp, Artificial Sequence
  Synthetic
ccgttttttttttttagctgaat

SEQ ID NO: 8746 - DNA, 23 bp, Artificial Sequence
  Synthetic
ccgttttttttttttgaagagag

SEQ ID NO: 8747 - DNA, 23 bp, Artificial Sequence
  Synthetic
ccgttttttttttttgaagagag

SEQ ID NO: 8748 - DNA, 23 bp, Artificial Sequence
  Synthetic
ccgttttttttttttcgcatcta

SEQ ID NO: 8749 - DNA, 23 bp, Artificial Sequence
  Synthetic
ccgttttttttttttctgcagct

SEQ ID NO: 8750 - DNA, 23 bp, Artificial Sequence
  Synthetic
ccgttttttttttttaacccaag

SEQ ID NO: 8751 - DNA, 23 bp, Artificial Sequence
  Synthetic
ccgttttttttttttaacatggc

SEQ ID NO: 8752 - DNA, 23 bp, Artificial Sequence
  Synthetic
ccgttttttttttttagcacgga

SEQ ID NO: 8753 - DNA, 23 bp, Artificial Sequence
  Synthetic
ccgttttttttttttctcggcag

SEQ ID NO: 8754 - DNA, 23 bp, Artificial Sequence
  Synthetic
ccgttttttttttttacacacag

SEQ ID NO: 8755 - DNA, 23 bp, Artificial Sequence
  Synthetic
ccgttttttttttttattgccgt

SEQ ID NO: 8756 - DNA, 23 bp, Artificial Sequence
  Synthetic
ccgttttttttttttggactaga

SEQ ID NO: 8757 - DNA, 23 bp, Artificial Sequence
  Synthetic
ccgttttttttttttgagcagag

SEQ ID NO: 8758 - DNA, 23 bp, Artificial Sequence
  Synthetic
ccgttttttttttttctgtaagc

SEQ ID NO: 8759 - DNA, 23 bp, Artificial Sequence
  Synthetic
ccgttttttttttttccgtacac

SEQ ID NO: 8760 - DNA, 23 bp, Artificial Sequence
  Synthetic
ccgttttttttttttctactctt

SEQ ID NO: 8761 - DNA, 23 bp, Artificial Sequence
  Synthetic
ccgttttttttttttctgggaac

SEQ ID NO: 8762 - DNA, 23 bp, Artificial Sequence
  Synthetic
ccgttttttttttttcactaccc

SEQ ID NO: 8763 - DNA, 23 bp, Artificial Sequence
  Synthetic
ccgttttttttttttgctatgcc

SEQ ID NO: 8764 - DNA, 23 bp, Artificial Sequence
  Synthetic
ccgttttttttttttactgaact

SEQ ID NO: 8765 - DNA, 23 bp, Artificial Sequence
  Synthetic
ccgttttttttttttctagactg

SEQ ID NO: 8766 - DNA, 23 bp, Artificial Sequence
  Synthetic
ccgttttttttttttgaaggcgg

SEQ ID NO: 8767 - DNA, 23 bp, Artificial Sequence
  Synthetic
ccgttttttttttttggacagct

SEQ ID NO: 8768 - DNA, 23 bp, Artificial Sequence
  Synthetic
ccgttttttttttttagctttgg

SEQ ID NO: 8769 - DNA, 23 bp, Artificial Sequence
  Synthetic
ccgttttttttttttcggctttc

SEQ ID NO: 8770 - DNA, 23 bp, Artificial Sequence
  Synthetic
ccgttttttttttttactagctt

SEQ ID NO: 8771 - DNA, 23 bp, Artificial Sequence
  Synthetic
ccgttttttttttttactggctt

SEQ ID NO: 8772 - DNA, 23 bp, Artificial Sequence
  Synthetic
ccgttttttttttttacactgaa

SEQ ID NO: 8773 - DNA, 23 bp, Artificial Sequence
  Synthetic
ccgttttttttttttgacagcat

SEQ ID NO: 8774 - DNA, 23 bp, Artificial Sequence
  Synthetic
ccgttttttttttttgcacgcct

SEQ ID NO: 8775 - DNA, 23 bp, Artificial Sequence
  Synthetic
ccgttttttttttttgactgtgg

SEQ ID NO: 8776 - DNA, 23 bp, Artificial Sequence
  Synthetic
ccgttttttttttttacacctga

SEQ ID NO: 8777 - DNA, 23 bp, Artificial Sequence
  Synthetic
ccgttttttttttttggggcatt

SEQ ID NO: 8778 - DNA, 23 bp, Artificial Sequence
  Synthetic
ccgttttttttttttaactatac

SEQ ID NO: 8779 - DNA, 23 bp, Artificial Sequence
  Synthetic
ccgttttttttttttcacacttg

SEQ ID NO: 8780 - DNA, 23 bp, Artificial Sequence
  Synthetic
ccgttttttttttttcgaaatgc

SEQ ID NO: 8781 - DNA, 23 bp, Artificial Sequence
  Synthetic
ccgttttttttttttacatactt

SEQ ID NO: 8782 - DNA, 23 bp, Artificial Sequence
  Synthetic
ccgttttttttttttggcattca

SEQ ID NO: 8783 - DNA, 23 bp, Artificial Sequence
  Synthetic
ccgttttttttttttgcacatca

SEQ ID NO: 8784 - DNA, 23 bp, Artificial Sequence
  Synthetic
ccgttttttttttttgttcagaa

SEQ ID NO: 8785 - DNA, 23 bp, Artificial Sequence
  Synthetic
ccgttttttttttttccgtgaat

SEQ ID NO: 8786 - DNA, 23 bp, Artificial Sequence
  Synthetic
ccgttttttttttttacgatgga

SEQ ID NO: 8787 - DNA, 23 bp, Artificial Sequence
  Synthetic
ccgttttttttttttctcctggt

SEQ ID NO: 8788 - DNA, 23 bp, Artificial Sequence
  Synthetic
ccgttttttttttttctgcctgt

SEQ ID NO: 8789 - DNA, 23 bp, Artificial Sequence
  Synthetic
ccgttttttttttttcaccgcag

SEQ ID NO: 8790 - DNA, 23 bp, Artificial Sequence
  Synthetic
ccgttttttttttttcccgcaca

SEQ ID NO: 8791 - DNA, 23 bp, Artificial Sequence
  Synthetic
ccgttttttttttttaagggtat

SEQ ID NO: 8792 - DNA, 23 bp, Artificial Sequence
  Synthetic
ccgttttttttttttcaggccgg

SEQ ID NO: 8793 - DNA, 23 bp, Artificial Sequence
  Synthetic
ccgttttttttttttagcgtcat

SEQ ID NO: 8794 - DNA, 23 bp, Artificial Sequence
  Synthetic
ccgttttttttttttaagctgtt

SEQ ID NO: 8795 - DNA, 23 bp, Artificial Sequence
  Synthetic
ccgttttttttttttctgaatgg

SEQ ID NO: 8796 - DNA, 23 bp, Artificial Sequence
  Synthetic
ccgttttttttttttccagtacc

SEQ ID NO: 8797 - DNA, 23 bp, Artificial Sequence
  Synthetic
ccgttttttttttttcagtactt

SEQ ID NO: 8798 - DNA, 23 bp, Artificial Sequence
  Synthetic
ccgttttttttttttagcgaaga

SEQ ID NO: 8799 - DNA, 23 bp, Artificial Sequence
  Synthetic
ccgttttttttttttcatttctc

SEQ ID NO: 8800 - DNA, 23 bp, Artificial Sequence
  Synthetic
ccgttttttttttttcgaagcaa

SEQ ID NO: 8801 - DNA, 23 bp, Artificial Sequence
  Synthetic
ccgttttttttttttgatatccc

SEQ ID NO: 8802 - DNA, 23 bp, Artificial Sequence
  Synthetic
ccgttttttttttttcataccac

SEQ ID NO: 8803 - DNA, 23 bp, Artificial Sequence
  Synthetic
ccgttttttttttttgagctact

SEQ ID NO: 8804 - DNA, 23 bp, Artificial Sequence
  Synthetic
ccgttttttttttttagctccta

SEQ ID NO: 8805 - DNA, 23 bp, Artificial Sequence
  Synthetic
ccgttttttttttttaagaagag

SEQ ID NO: 8806 - DNA, 23 bp, Artificial Sequence
  Synthetic
ccgttttttttttttgagcgtta

SEQ ID NO: 8807 - DNA, 23 bp, Artificial Sequence
  Synthetic
ccgttttttttttttgcaacgct

SEQ ID NO: 8808 - DNA, 23 bp, Artificial Sequence
  Synthetic
ccgttttttttttttccatgcca

SEQ ID NO: 8809 - DNA, 23 bp, Artificial Sequence
  Synthetic
ccgttttttttttttaataagag

SEQ ID NO: 8810 - DNA, 23 bp, Artificial Sequence
  Synthetic
ccgttttttttttttgttacctg

SEQ ID NO: 8811 - DNA, 23 bp, Artificial Sequence
  Synthetic
ccgttttttttttttggtcagtg

SEQ ID NO: 8812 - DNA, 23 bp, Artificial Sequence
  Synthetic
ccgttttttttttttcctacagt

SEQ ID NO: 8813 - DNA, 23 bp, Artificial Sequence
  Synthetic
ccgttttttttttttacagtctt

SEQ ID NO: 8814 - DNA, 23 bp, Artificial Sequence
  Synthetic
ccgttttttttttttcactgggt

SEQ ID NO: 8815 - DNA, 23 bp, Artificial Sequence
  Synthetic
ccgttttttttttttaaaaggat

SEQ ID NO: 8816 - DNA, 23 bp, Artificial Sequence
  Synthetic
ccgttttttttttttaccagatt

SEQ ID NO: 8817 - DNA, 23 bp, Artificial Sequence
  Synthetic
ccgttttttttttttctacaaga

SEQ ID NO: 8818 - DNA, 23 bp, Artificial Sequence
  Synthetic
ccgttttttttttttcgtgaaaa

SEQ ID NO: 8819 - DNA, 23 bp, Artificial Sequence
  Synthetic
ccgttttttttttttatcagaaa

SEQ ID NO: 8820 - DNA, 23 bp, Artificial Sequence
  Synthetic
ccgttttttttttttcataacaa

SEQ ID NO: 8821 - DNA, 23 bp, Artificial Sequence
  Synthetic
ccgttttttttttttataccacc

SEQ ID NO: 8822 - DNA, 23 bp, Artificial Sequence
  Synthetic
ccgttttttttttttgctttgcc

SEQ ID NO: 8823 - DNA, 23 bp, Artificial Sequence
  Synthetic
ccgttttttttttttgcagcaga

SEQ ID NO: 8824 - DNA, 23 bp, Artificial Sequence
  Synthetic
ccgttttttttttttaccaaact

SEQ ID NO: 8825 - DNA, 23 bp, Artificial Sequence
  Synthetic
ccgttttttttttttagttttgc

SEQ ID NO: 8826 - DNA, 23 bp, Artificial Sequence
  Synthetic
ccgttttttttttttctccactg

SEQ ID NO: 8827 - DNA, 23 bp, Artificial Sequence
  Synthetic
ccgttttttttttttaatgcttt

SEQ ID NO: 8828 - DNA, 23 bp, Artificial Sequence
  Synthetic
ccgttttttttttttcaaacacc

SEQ ID NO: 8829 - DNA, 23 bp, Artificial Sequence
  Synthetic
ccgttttttttttttcagccgac

SEQ ID NO: 8830 - DNA, 23 bp, Artificial Sequence
  Synthetic
ccgttttttttttttcaaccagc

SEQ ID NO: 8831 - DNA, 23 bp, Artificial Sequence
  Synthetic
ccgttttttttttttactgctag

SEQ ID NO: 8832 - DNA, 23 bp, Artificial Sequence
  Synthetic
ccgttttttttttttaataccaa

SEQ ID NO: 8833 - DNA, 23 bp, Artificial Sequence
  Synthetic
ccgttttttttttttaggagcag

SEQ ID NO: 8834 - DNA, 23 bp, Artificial Sequence
  Synthetic
ccgttttttttttttcatagctc

SEQ ID NO: 8835 - DNA, 23 bp, Artificial Sequence
  Synthetic
ccgttttttttttttgatttgtt

SEQ ID NO: 8836 - DNA, 23 bp, Artificial Sequence
  Synthetic
ccgttttttttttttcctgcaac

SEQ ID NO: 8837 - DNA, 23 bp, Artificial Sequence
  Synthetic
ccgttttttttttttccttgaca

SEQ ID NO: 8838 - DNA, 23 bp, Artificial Sequence
  Synthetic
ccgttttttttttttcgtcagag

SEQ ID NO: 8839 - DNA, 23 bp, Artificial Sequence
  Synthetic
ccgttttttttttttcatgcgaa

SEQ ID NO: 8840 - DNA, 23 bp, Artificial Sequence
  Synthetic
ccgttttttttttttgtgaacgg

SEQ ID NO: 8841 - DNA, 23 bp, Artificial Sequence
  Synthetic
ccgttttttttttttactgcaag

SEQ ID NO: 8842 - DNA, 23 bp, Artificial Sequence
  Synthetic
ccgttttttttttttactccagt

SEQ ID NO: 8843 - DNA, 23 bp, Artificial Sequence
  Synthetic
ccgttttttttttttcaagctga

SEQ ID NO: 8844 - DNA, 23 bp, Artificial Sequence
  Synthetic
ccgttttttttttttcatcacac

SEQ ID NO: 8845 - DNA, 23 bp, Artificial Sequence
  Synthetic
ccgttttttttttttagctgatg

SEQ ID NO: 8846 - DNA, 23 bp, Artificial Sequence
  Synthetic
ccgttttttttttttaggtgatt

SEQ ID NO: 8847 - DNA, 23 bp, Artificial Sequence
  Synthetic
ccgttttttttttttctgtagat

SEQ ID NO: 8848 - DNA, 23 bp, Artificial Sequence
  Synthetic
ccgttttttttttttgcgacagc

SEQ ID NO: 8849 - DNA, 23 bp, Artificial Sequence
  Synthetic
ccgttttttttttttagctgaat

SEQ ID NO: 8850 - DNA, 23 bp, Artificial Sequence
  Synthetic
ccgttttttttttttagctgaat

SEQ ID NO: 8851 - DNA, 23 bp, Artificial Sequence
  Synthetic
ccgttttttttttttgaagagag

SEQ ID NO: 8852 - DNA, 23 bp, Artificial Sequence
  Synthetic
ccgttttttttttttgaagagag

SEQ ID NO: 8853 - DNA, 23 bp, Artificial Sequence
  Synthetic
ccgttttttttttttcgcatcta

SEQ ID NO: 8854 - DNA, 23 bp, Artificial Sequence
  Synthetic
ccgttttttttttttctgcagct

SEQ ID NO: 8855 - DNA, 23 bp, Artificial Sequence
  Synthetic
ccgttttttttttttaacccaag

SEQ ID NO: 8856 - DNA, 23 bp, Artificial Sequence
  Synthetic
ccgttttttttttttaacatgga

SEQ ID NO: 8857 - DNA, 23 bp, Artificial Sequence
  Synthetic
ccgttttttttttttagcacgga

SEQ ID NO: 8858 - DNA, 23 bp, Artificial Sequence
  Synthetic
ccgttttttttttttagcacgga

SEQ ID NO: 8859 - DNA, 23 bp, Artificial Sequence
  Synthetic
ccgttttttttttttctcggatt

SEQ ID NO: 8860 - DNA, 23 bp, Artificial Sequence
  Synthetic
ccgttttttttttttctcagcag

SEQ ID NO: 8861 - DNA, 23 bp, Artificial Sequence
  Synthetic
ccgttttttttttttctcagcgg

SEQ ID NO: 8862 - DNA, 23 bp, Artificial Sequence
  Synthetic
ccgttttttttttttacaaccca

SEQ ID NO: 8863 - DNA, 23 bp, Artificial Sequence
  Synthetic
ccgttttttttttttacacacag

SEQ ID NO: 8864 - DNA, 23 bp, Artificial Sequence
  Synthetic
ccgttttttttttttattgccgt

SEQ ID NO: 8865 - DNA, 23 bp, Artificial Sequence
  Synthetic
ccgttttttttttttcatcatcc

SEQ ID NO: 8866 - DNA, 23 bp, Artificial Sequence
  Synthetic
ccgttttttttttttgaactaga

SEQ ID NO: 8867 - DNA, 23 bp, Artificial Sequence
  Synthetic
ccgttttttttttttgagatgag

SEQ ID NO: 8868 - DNA, 23 bp, Artificial Sequence
  Synthetic
ccgttttttttttttctgtaagc

SEQ ID NO: 8869 - DNA, 23 bp, Artificial Sequence
  Synthetic
ccgttttttttttttccaactcg

SEQ ID NO: 8870 - DNA, 23 bp, Artificial Sequence
  Synthetic
ccgttttttttttttcggtaacg

SEQ ID NO: 8871 - DNA, 23 bp, Artificial Sequence
  Synthetic
ccgttttttttttttcggttacg

SEQ ID NO: 8872 - DNA, 23 bp, Artificial Sequence
  Synthetic
ccgttttttttttttcacatccc

SEQ ID NO: 8873 - DNA, 23 bp, Artificial Sequence
  Synthetic
ccgttttttttttttctactctt

SEQ ID NO: 8874 - DNA, 23 bp, Artificial Sequence
  Synthetic
ccgttttttttttttatggaaac

SEQ ID NO: 8875 - DNA, 23 bp, Artificial Sequence
  Synthetic
ccgttttttttttttcactaccc

SEQ ID NO: 8876 - DNA, 23 bp, Artificial Sequence
  Synthetic
ccgttttttttttttgctatgcc

SEQ ID NO: 8877 - DNA, 23 bp, Artificial Sequence
  Synthetic
ccgttttttttttttactgaact

SEQ ID NO: 8878 - DNA, 23 bp, Artificial Sequence
  Synthetic
ccgttttttttttttgtagactg

SEQ ID NO: 8879 - DNA, 23 bp, Artificial Sequence
  Synthetic
ccgttttttttttttgaagccgg

SEQ ID NO: 8880 - DNA, 23 bp, Artificial Sequence
  Synthetic
ccgttttttttttttcaaggctt

SEQ ID NO: 8881 - DNA, 23 bp, Artificial Sequence
  Synthetic
ccgttttttttttttggacagct

SEQ ID NO: 8882 - DNA, 23 bp, Artificial Sequence
  Synthetic
ccgttttttttttttgcacaaac

SEQ ID NO: 8883 - DNA, 23 bp, Artificial Sequence
  Synthetic
ccgttttttttttttagctttgg

SEQ ID NO: 8884 - DNA, 23 bp, Artificial Sequence
  Synthetic
ccgttttttttttttcggctttc

SEQ ID NO: 8885 - DNA, 23 bp, Artificial Sequence
  Synthetic
ccgttttttttttttactagctt

SEQ ID NO: 8886 - DNA, 23 bp, Artificial Sequence
  Synthetic
ccgttttttttttttactggctt

SEQ ID NO: 8887 - DNA, 23 bp, Artificial Sequence
  Synthetic
ccgttttttttttttactgaatt

SEQ ID NO: 8888 - DNA, 23 bp, Artificial Sequence
  Synthetic
ccgttttttttttttacaatatt

SEQ ID NO: 8889 - DNA, 23 bp, Artificial Sequence
  Synthetic
ccgttttttttttttgcacgact

SEQ ID NO: 8890 - DNA, 23 bp, Artificial Sequence
  Synthetic
ccgttttttttttttgactgtgg

SEQ ID NO: 8891 - DNA, 23 bp, Artificial Sequence
  Synthetic
ccgttttttttttttacacctga

SEQ ID NO: 8892 - DNA, 23 bp, Artificial Sequence
  Synthetic
ccgttttttttttttggggcatt

SEQ ID NO: 8893 - DNA, 23 bp, Artificial Sequence
  Synthetic
ccgttttttttttttataaggat

SEQ ID NO: 8894 - DNA, 23 bp, Artificial Sequence
  Synthetic
ccgttttttttttttacggcatt

SEQ ID NO: 8895 - DNA, 23 bp, Artificial Sequence
  Synthetic
ccgttttttttttttatgggaca

SEQ ID NO: 8896 - DNA, 23 bp, Artificial Sequence
  Synthetic
ccgttttttttttttaccagcta

SEQ ID NO: 8897 - DNA, 23 bp, Artificial Sequence
  Synthetic
ccgttttttttttttattaggaa

SEQ ID NO: 8898 - DNA, 23 bp, Artificial Sequence
  Synthetic
ccgttttttttttttaatcagct

SEQ ID NO: 8899 - DNA, 23 bp, Artificial Sequence
  Synthetic
ccgttttttttttttactataca

SEQ ID NO: 8900 - DNA, 23 bp, Artificial Sequence
  Synthetic
ccgttttttttttttctccatac

SEQ ID NO: 8901 - DNA, 23 bp, Artificial Sequence
  Synthetic
ccgttttttttttttacaaattc

SEQ ID NO: 8902 - DNA, 23 bp, Artificial Sequence
  Synthetic
ccgttttttttttttcacaagtt

SEQ ID NO: 8903 - DNA, 23 bp, Artificial Sequence
  Synthetic
ccgttttttttttttgcaagaac

SEQ ID NO: 8904 - DNA, 23 bp, Artificial Sequence
  Synthetic
ccgttttttttttttaccagtac

SEQ ID NO: 8905 - DNA, 23 bp, Artificial Sequence
  Synthetic
ccgttttttttttttcttggcat

SEQ ID NO: 8906 - DNA, 23 bp, Artificial Sequence
  Synthetic
ccgttttttttttttcacaagtt

SEQ ID NO: 8907 - DNA, 23 bp, Artificial Sequence
  Synthetic
ccgttttttttttttacagctgg

SEQ ID NO: 8908 - DNA, 23 bp, Artificial Sequence
  Synthetic
ccgttttttttttttactcatca

SEQ ID NO: 8909 - DNA, 23 bp, Artificial Sequence
  Synthetic
ccgttttttttttttactcgtca

SEQ ID NO: 8910 - DNA, 23 bp, Artificial Sequence
  Synthetic
ccgttttttttttttaggagaga

SEQ ID NO: 8911 - DNA, 23 bp, Artificial Sequence
  Synthetic
ccgttttttttttttgcccttat

SEQ ID NO: 8912 - DNA, 23 bp, Artificial Sequence
  Synthetic
ccgttttttttttttcggggcga

SEQ ID NO: 8913 - DNA, 23 bp, Artificial Sequence
  Synthetic
ccgttttttttttttagccgctg

SEQ ID NO: 8914 - DNA, 23 bp, Artificial Sequence
  Synthetic
ccgttttttttttttcaagaatt

SEQ ID NO: 8915 - DNA, 23 bp, Artificial Sequence
  Synthetic
ccgttttttttttttgtgaattc

SEQ ID NO: 8916 - DNA, 23 bp, Artificial Sequence
  Synthetic
ccgttttttttttttgtgaattc

SEQ ID NO: 8917 - DNA, 23 bp, Artificial Sequence
  Synthetic
ccgttttttttttttattacccg

SEQ ID NO: 8918 - DNA, 23 bp, Artificial Sequence
  Synthetic
ccgttttttttttttcgcgcgct

SEQ ID NO: 8919 - DNA, 23 bp, Artificial Sequence
  Synthetic
ccgttttttttttttcgtaggaa

SEQ ID NO: 8920 - DNA, 23 bp, Artificial Sequence
  Synthetic
ccgttttttttttttagagcacg

SEQ ID NO: 8921 - DNA, 23 bp, Artificial Sequence
  Synthetic
ccgttttttttttttagagcacg

SEQ ID NO: 8922 - DNA, 23 bp, Artificial Sequence
  Synthetic
ccgttttttttttttgtcgtacc

SEQ ID NO: 8923 - DNA, 23 bp, Artificial Sequence
  Synthetic
ccgttttttttttttaaacggac

SEQ ID NO: 8924 - DNA, 23 bp, Artificial Sequence
  Synthetic
ccgttttttttttttaatgagtg

SEQ ID NO: 8925 - DNA, 23 bp, Artificial Sequence
  Synthetic
ccgttttttttttttatcatttc

SEQ ID NO: 8926 - DNA, 23 bp, Artificial Sequence
  Synthetic
ccgttttttttttttacaaagag

SEQ ID NO: 8927 - DNA, 23 bp, Artificial Sequence
  Synthetic
ccgttttttttttttactgtcga

SEQ ID NO: 8928 - DNA, 23 bp, Artificial Sequence
  Synthetic
ccgttttttttttttactgtcga

SEQ ID NO: 8929 - DNA, 23 bp, Artificial Sequence
  Synthetic
ccgttttttttttttacagacaa

SEQ ID NO: 8930 - DNA, 23 bp, Artificial Sequence
  Synthetic
ccgttttttttttttagaattac

SEQ ID NO: 8931 - DNA, 23 bp, Artificial Sequence
  Synthetic
ccgttttttttttttcaattgct

SEQ ID NO: 8932 - DNA, 23 bp, Artificial Sequence
  Synthetic
ccgttttttttttttgcactgat

SEQ ID NO: 8933 - DNA, 23 bp, Artificial Sequence
  Synthetic
ccgttttttttttttagcacgag

SEQ ID NO: 8934 - DNA, 23 bp, Artificial Sequence
  Synthetic
ccgttttttttttttgtgcaaac

SEQ ID NO: 8935 - DNA, 23 bp, Artificial Sequence
  Synthetic
ccgttttttttttttcatgaaat

SEQ ID NO: 8936 - DNA, 23 bp, Artificial Sequence
  Synthetic
ccgttttttttttttagtcgcag

SEQ ID NO: 8937 - DNA, 23 bp, Artificial Sequence
  Synthetic
ccgttttttttttttgctcatca

SEQ ID NO: 8938 - DNA, 23 bp, Artificial Sequence
  Synthetic
ccgttttttttttttgctcctca

SEQ ID NO: 8939 - DNA, 23 bp, Artificial Sequence
  Synthetic
ccgttttttttttttgcccatca

SEQ ID NO: 8940 - DNA, 23 bp, Artificial Sequence
  Synthetic
ccgttttttttttttgagacaca

SEQ ID NO: 8941 - DNA, 23 bp, Artificial Sequence
  Synthetic
ccgttttttttttttaccagttt

SEQ ID NO: 8942 - DNA, 23 bp, Artificial Sequence
  Synthetic
ccgttttttttttttctcacatt

SEQ ID NO: 8943 - DNA, 23 bp, Artificial Sequence
  Synthetic
ccgttttttttttttcagagcac

SEQ ID NO: 8944 - DNA, 23 bp, Artificial Sequence
  Synthetic
ccgttttttttttttgagagtca

SEQ ID NO: 8945 - DNA, 23 bp, Artificial Sequence
  Synthetic
ccgttttttttttttgcacaggc

SEQ ID NO: 8946 - DNA, 23 bp, Artificial Sequence
  Synthetic
ccgttttttttttttctcactca

SEQ ID NO: 8947 - DNA, 23 bp, Artificial Sequence
  Synthetic
ccgttttttttttttctcacagt

SEQ ID NO: 8948 - DNA, 23 bp, Artificial Sequence
  Synthetic
ccgttttttttttttaggacaaa

SEQ ID NO: 8949 - DNA, 23 bp, Artificial Sequence
  Synthetic
ccgttttttttttttaaaggccg

SEQ ID NO: 8950 - DNA, 23 bp, Artificial Sequence
  Synthetic
ccgttttttttttttcaggccgg

SEQ ID NO: 8951 - DNA, 23 bp, Artificial Sequence
  Synthetic
ccgttttttttttttcaggccgt

SEQ ID NO: 8952 - DNA, 23 bp, Artificial Sequence
  Synthetic
ccgttttttttttttcgggctgt

SEQ ID NO: 8953 - DNA, 23 bp, Artificial Sequence
  Synthetic
ccgttttttttttttccgaactt

SEQ ID NO: 8954 - DNA, 23 bp, Artificial Sequence
  Synthetic
ccgttttttttttttgctttctg

SEQ ID NO: 8955 - DNA, 23 bp, Artificial Sequence
  Synthetic
ccgttttttttttttcgccagta

SEQ ID NO: 8956 - DNA, 23 bp, Artificial Sequence
  Synthetic
ccgttttttttttttactggata

SEQ ID NO: 8957 - DNA, 23 bp, Artificial Sequence
  Synthetic
ccgttttttttttttgagataaa

SEQ ID NO: 8958 - DNA, 23 bp, Artificial Sequence
  Synthetic
ccgttttttttttttcagctatg

SEQ ID NO: 8959 - DNA, 23 bp, Artificial Sequence
  Synthetic
ccgttttttttttttcagctatt

SEQ ID NO: 8960 - DNA, 23 bp, Artificial Sequence
  Synthetic
ccgttttttttttttcaatgcga

SEQ ID NO: 8961 - DNA, 23 bp, Artificial Sequence
  Synthetic
ccgttttttttttttcaaccagc

SEQ ID NO: 8962 - DNA, 23 bp, Artificial Sequence
  Synthetic
ccgttttttttttttcaatggtt

SEQ ID NO: 8963 - DNA, 23 bp, Artificial Sequence
  Synthetic
ccgttttttttttttcatatcac

SEQ ID NO: 8964 - DNA, 23 bp, Artificial Sequence
  Synthetic
ccgttttttttttttaaaaagaa

SEQ ID NO: 8965 - DNA, 23 bp, Artificial Sequence
  Synthetic
ccgttttttttttttacaacaaa

SEQ ID NO: 8966 - DNA, 23 bp, Artificial Sequence
  Synthetic
ccgttttttttttttatgctttg

SEQ ID NO: 8967 - DNA, 23 bp, Artificial Sequence
  Synthetic
ccgttttttttttttgacatctt

SEQ ID NO: 8968 - DNA, 23 bp, Artificial Sequence
  Synthetic
ccgttttttttttttcacacctg

SEQ ID NO: 8969 - DNA, 23 bp, Artificial Sequence
  Synthetic
ccgttttttttttttataggccg

SEQ ID NO: 8970 - DNA, 23 bp, Artificial Sequence
  Synthetic
ccgttttttttttttgcaggccg

SEQ ID NO: 8971 - DNA, 23 bp, Artificial Sequence
  Synthetic
ccgttttttttttttcatacagc

SEQ ID NO: 8972 - DNA, 23 bp, Artificial Sequence
  Synthetic
ccgttttttttttttcatacagc

SEQ ID NO: 8973 - DNA, 23 bp, Artificial Sequence
  Synthetic
ccgttttttttttttctacagct

SEQ ID NO: 8974 - DNA, 23 bp, Artificial Sequence
  Synthetic
ccgttttttttttttgttacgta

SEQ ID NO: 8975 - DNA, 23 bp, Artificial Sequence
  Synthetic
ccgttttttttttttcaggatac

SEQ ID NO: 8976 - DNA, 23 bp, Artificial Sequence
  Synthetic
ccgttttttttttttaatcagct

SEQ ID NO: 8977 - DNA, 23 bp, Artificial Sequence
  Synthetic
ccgttttttttttttactataca

SEQ ID NO: 8978 - DNA, 23 bp, Artificial Sequence
  Synthetic
ccgttttttttttttctccatac

SEQ ID NO: 8979 - DNA, 23 bp, Artificial Sequence
  Synthetic
ccgttttttttttttacaaattc

SEQ ID NO: 8980 - DNA, 23 bp, Artificial Sequence
  Synthetic
ccgttttttttttttcacaagtt

SEQ ID NO: 8981 - DNA, 23 bp, Artificial Sequence
  Synthetic
ccgttttttttttttgcaagaac

SEQ ID NO: 8982 - DNA, 23 bp, Artificial Sequence
  Synthetic
ccgttttttttttttaccagtac

SEQ ID NO: 8983 - DNA, 23 bp, Artificial Sequence
  Synthetic
ccgttttttttttttcttggcat

SEQ ID NO: 8984 - DNA, 23 bp, Artificial Sequence
  Synthetic
ccgttttttttttttcacaagtt

SEQ ID NO: 8985 - DNA, 23 bp, Artificial Sequence
  Synthetic
ccgttttttttttttacagctgg

SEQ ID NO: 8986 - DNA, 23 bp, Artificial Sequence
  Synthetic
ccgttttttttttttactcatca

SEQ ID NO: 8987 - DNA, 23 bp, Artificial Sequence
  Synthetic
ccgttttttttttttactcgtca

SEQ ID NO: 8988 - DNA, 23 bp, Artificial Sequence
  Synthetic
ccgttttttttttttaggagaga

SEQ ID NO: 8989 - DNA, 23 bp, Artificial Sequence
  Synthetic
ccgttttttttttttgcccttat

SEQ ID NO: 8990 - DNA, 23 bp, Artificial Sequence
  Synthetic
ccgttttttttttttagccgctg

SEQ ID NO: 8991 - DNA, 23 bp, Artificial Sequence
  Synthetic
ccgttttttttttttcaagaatt

SEQ ID NO: 8992 - DNA, 23 bp, Artificial Sequence
  Synthetic
ccgttttttttttttgtgaattc

SEQ ID NO: 8993 - DNA, 23 bp, Artificial Sequence
  Synthetic
ccgttttttttttttgtgaattc

SEQ ID NO: 8994 - DNA, 23 bp, Artificial Sequence
  Synthetic
ccgttttttttttttattacccg

SEQ ID NO: 8995 - DNA, 23 bp, Artificial Sequence
  Synthetic
ccgttttttttttttcgcgcgct

SEQ ID NO: 8996 - DNA, 23 bp, Artificial Sequence
  Synthetic
ccgttttttttttttagagcacg

SEQ ID NO: 8997 - DNA, 23 bp, Artificial Sequence
  Synthetic
ccgttttttttttttagagcacg

SEQ ID NO: 8998 - DNA, 23 bp, Artificial Sequence
  Synthetic
ccgttttttttttttgtcgtacc

SEQ ID NO: 8999 - DNA, 23 bp, Artificial Sequence
  Synthetic
ccgttttttttttttaaacggac

SEQ ID NO: 9000 - DNA, 23 bp, Artificial Sequence
  Synthetic
ccgttttttttttttaatgagtg

SEQ ID NO: 9001 - DNA, 23 bp, Artificial Sequence
  Synthetic
ccgttttttttttttatcatttc

SEQ ID NO: 9002 - DNA, 23 bp, Artificial Sequence
  Synthetic
ccgttttttttttttacaaagag

SEQ ID NO: 9003 - DNA, 23 bp, Artificial Sequence
  Synthetic
ccgttttttttttttacagacaa

SEQ ID NO: 9004 - DNA, 23 bp, Artificial Sequence
  Synthetic
ccgttttttttttttagaattac

SEQ ID NO: 9005 - DNA, 23 bp, Artificial Sequence
  Synthetic
ccgttttttttttttcaattgct

SEQ ID NO: 9006 - DNA, 23 bp, Artificial Sequence
  Synthetic
ccgttttttttttttgcactgat

SEQ ID NO: 9007 - DNA, 23 bp, Artificial Sequence
  Synthetic
ccgttttttttttttagcacgag

SEQ ID NO: 9008 - DNA, 23 bp, Artificial Sequence
  Synthetic
ccgttttttttttttgtgcaaac

SEQ ID NO: 9009 - DNA, 23 bp, Artificial Sequence
  Synthetic
ccgttttttttttttcatgaaat

SEQ ID NO: 9010 - DNA, 23 bp, Artificial Sequence
  Synthetic
ccgttttttttttttagtcgcag

SEQ ID NO: 9011 - DNA, 23 bp, Artificial Sequence
  Synthetic
ccgttttttttttttgctcatca

SEQ ID NO: 9012 - DNA, 23 bp, Artificial Sequence
  Synthetic
ccgttttttttttttgctcctca

SEQ ID NO: 9013 - DNA, 23 bp, Artificial Sequence
  Synthetic
ccgttttttttttttgcccatca

SEQ ID NO: 9014 - DNA, 23 bp, Artificial Sequence
  Synthetic
ccgttttttttttttgagacaca

SEQ ID NO: 9015 - DNA, 23 bp, Artificial Sequence
  Synthetic
ccgttttttttttttctcacatt

SEQ ID NO: 9016 - DNA, 23 bp, Artificial Sequence
  Synthetic
ccgttttttttttttcagagcac

SEQ ID NO: 9017 - DNA, 23 bp, Artificial Sequence
  Synthetic
ccgttttttttttttgagagtca

SEQ ID NO: 9018 - DNA, 23 bp, Artificial Sequence
  Synthetic
ccgttttttttttttctcactca

SEQ ID NO: 9019 - DNA, 23 bp, Artificial Sequence
  Synthetic
ccgttttttttttttctcacagt

SEQ ID NO: 9020 - DNA, 23 bp, Artificial Sequence
  Synthetic
ccgttttttttttttaagacaaa

SEQ ID NO: 9021 - DNA, 23 bp, Artificial Sequence
  Synthetic
ccgttttttttttttccgaactt

SEQ ID NO: 9022 - DNA, 23 bp, Artificial Sequence
  Synthetic
ccgttttttttttttgctttctg

SEQ ID NO: 9023 - DNA, 23 bp, Artificial Sequence
  Synthetic
ccgttttttttttttcgccagta

SEQ ID NO: 9024 - DNA, 23 bp, Artificial Sequence
  Synthetic
ccgttttttttttttattggata

SEQ ID NO: 9025 - DNA, 23 bp, Artificial Sequence
  Synthetic
ccgttttttttttttgagataaa

SEQ ID NO: 9026 - DNA, 23 bp, Artificial Sequence
  Synthetic
ccgttttttttttttcagctatg

SEQ ID NO: 9027 - DNA, 23 bp, Artificial Sequence
  Synthetic
ccgttttttttttttcagctatt

SEQ ID NO: 9028 - DNA, 23 bp, Artificial Sequence
  Synthetic
ccgttttttttttttcaatgcga

SEQ ID NO: 9029 - DNA, 23 bp, Artificial Sequence
  Synthetic
ccgttttttttttttcaaccagc

SEQ ID NO: 9030 - DNA, 23 bp, Artificial Sequence
  Synthetic
ccgttttttttttttcaatggtt

SEQ ID NO: 9031 - DNA, 23 bp, Artificial Sequence
  Synthetic
ccgttttttttttttcatatcac

SEQ ID NO: 9032 - DNA, 23 bp, Artificial Sequence
  Synthetic
ccgttttttttttttaaaaagaa

SEQ ID NO: 9033 - DNA, 23 bp, Artificial Sequence
  Synthetic
ccgttttttttttttacaacaaa

SEQ ID NO: 9034 - DNA, 23 bp, Artificial Sequence
  Synthetic
ccgttttttttttttatgctttg

SEQ ID NO: 9035 - DNA, 23 bp, Artificial Sequence
  Synthetic
ccgttttttttttttgacatctt

SEQ ID NO: 9036 - DNA, 23 bp, Artificial Sequence
  Synthetic
ccgttttttttttttcacacctg

SEQ ID NO: 9037 - DNA, 23 bp, Artificial Sequence
  Synthetic
ccgttttttttttttataggccg

SEQ ID NO: 9038 - DNA, 23 bp, Artificial Sequence
  Synthetic
ccgttttttttttttgcaggccg

SEQ ID NO: 9039 - DNA, 23 bp, Artificial Sequence
  Synthetic
ccgttttttttttttcatacagc

SEQ ID NO: 9040 - DNA, 23 bp, Artificial Sequence
  Synthetic
ccgttttttttttttcatacagc

SEQ ID NO: 9041 - DNA, 23 bp, Artificial Sequence
  Synthetic
ccgttttttttttttctacagct

SEQ ID NO: 9042 - DNA, 23 bp, Artificial Sequence
  Synthetic
ccgttttttttttttgttacgta

SEQ ID NO: 9043 - DNA, 23 bp, Artificial Sequence
  Synthetic
ccgttttttttttttcaggatac

SEQ ID NO: 9044 - DNA, 23 bp, Artificial Sequence
  Synthetic
ccgttttttttttttaactatac

SEQ ID NO: 9045 - DNA, 23 bp, Artificial Sequence
  Synthetic
ccgttttttttttttaaccacac

SEQ ID NO: 9046 - DNA, 23 bp, Artificial Sequence
  Synthetic
ccgttttttttttttaaccatac

SEQ ID NO: 9047 - DNA, 23 bp, Artificial Sequence
  Synthetic
ccgttttttttttttaaccatac

SEQ ID NO: 9048 - DNA, 23 bp, Artificial Sequence
  Synthetic
ccgttttttttttttaactattc

SEQ ID NO: 9049 - DNA, 23 bp, Artificial Sequence
  Synthetic
ccgttttttttttttaactatac

SEQ ID NO: 9050 - DNA, 23 bp, Artificial Sequence
  Synthetic
ccgttttttttttttaactatac

SEQ ID NO: 9051 - DNA, 23 bp, Artificial Sequence
  Synthetic
ccgttttttttttttaacaacac

SEQ ID NO: 9052 - DNA, 23 bp, Artificial Sequence
  Synthetic
ccgttttttttttttaacagcac

SEQ ID NO: 9053 - DNA, 23 bp, Artificial Sequence
  Synthetic
ccgttttttttttttaactgtac

SEQ ID NO: 9054 - DNA, 23 bp, Artificial Sequence
  Synthetic
ccgttttttttttttatacatac

SEQ ID NO: 9055 - DNA, 23 bp, Artificial Sequence
  Synthetic
ccgttttttttttttcacaagtt

SEQ ID NO: 9056 - DNA, 23 bp, Artificial Sequence
  Synthetic
ccgttttttttttttcttcagtt

SEQ ID NO: 9057 - DNA, 23 bp, Artificial Sequence
  Synthetic
ccgttttttttttttcttcagtt

SEQ ID NO: 9058 - DNA, 23 bp, Artificial Sequence
  Synthetic
ccgttttttttttttcatagccc

SEQ ID NO: 9059 - DNA, 23 bp, Artificial Sequence
  Synthetic
ccgttttttttttttgatagccc

SEQ ID NO: 9060 - DNA, 23 bp, Artificial Sequence
  Synthetic
ccgttttttttttttacaaattc

SEQ ID NO: 9061 - DNA, 23 bp, Artificial Sequence
  Synthetic
ccgttttttttttttattcccca

SEQ ID NO: 9062 - DNA, 23 bp, Artificial Sequence
  Synthetic
ccgttttttttttttcacaaatt

SEQ ID NO: 9063 - DNA, 23 bp, Artificial Sequence
  Synthetic
ccgttttttttttttacaaatcc

SEQ ID NO: 9064 - DNA, 23 bp, Artificial Sequence
  Synthetic
ccgttttttttttttcacacatt

SEQ ID NO: 9065 - DNA, 23 bp, Artificial Sequence
  Synthetic
ccgttttttttttttactcccct

SEQ ID NO: 9066 - DNA, 23 bp, Artificial Sequence
  Synthetic
ccgttttttttttttcaaacacc

SEQ ID NO: 9067 - DNA, 23 bp, Artificial Sequence
  Synthetic
ccgttttttttttttggcattca

SEQ ID NO: 9068 - DNA, 23 bp, Artificial Sequence
  Synthetic
ccgttttttttttttcacaggtt

SEQ ID NO: 9069 - DNA, 23 bp, Artificial Sequence
  Synthetic
ccgttttttttttttcacaagtt

SEQ ID NO: 9070 - DNA, 23 bp, Artificial Sequence
  Synthetic
ccgttttttttttttcacgagtt

SEQ ID NO: 9071 - DNA, 23 bp, Artificial Sequence
  Synthetic
ccgttttttttttttgcattatt

SEQ ID NO: 9072 - DNA, 23 bp, Artificial Sequence
  Synthetic
ccgttttttttttttcgcgtacc

SEQ ID NO: 9073 - DNA, 23 bp, Artificial Sequence
  Synthetic
ccgttttttttttttaaaagaga

SEQ ID NO: 9074 - DNA, 23 bp, Artificial Sequence
  Synthetic
ccgttttttttttttagcaagcc

SEQ ID NO: 9075 - DNA, 23 bp, Artificial Sequence
  Synthetic
ccgttttttttttttatgctttt

SEQ ID NO: 9076 - DNA, 23 bp, Artificial Sequence
  Synthetic
ccgttttttttttttatgccctt

SEQ ID NO: 9077 - DNA, 23 bp, Artificial Sequence
  Synthetic
ccgttttttttttttatgccctt

SEQ ID NO: 9078 - DNA, 23 bp, Artificial Sequence
  Synthetic
ccgttttttttttttatgccctt

SEQ ID NO: 9079 - DNA, 23 bp, Artificial Sequence
  Synthetic
ccgttttttttttttcgaccatg

SEQ ID NO: 9080 - DNA, 23 bp, Artificial Sequence
  Synthetic
ccgttttttttttttagtaacaa

SEQ ID NO: 9081 - DNA, 23 bp, Artificial Sequence
  Synthetic
ccgttttttttttttcagctggt

SEQ ID NO: 9082 - DNA, 23 bp, Artificial Sequence
  Synthetic
ccgttttttttttttatttggtt

SEQ ID NO: 9083 - DNA, 23 bp, Artificial Sequence
  Synthetic
ccgttttttttttttagctggtt

SEQ ID NO: 9084 - DNA, 23 bp, Artificial Sequence
  Synthetic
ccgttttttttttttgacttggt

SEQ ID NO: 9085 - DNA, 23 bp, Artificial Sequence
  Synthetic
ccgttttttttttttagctggtt

SEQ ID NO: 9086 - DNA, 23 bp, Artificial Sequence
  Synthetic
ccgttttttttttttcacatagg

SEQ ID NO: 9087 - DNA, 23 bp, Artificial Sequence
  Synthetic
ccgttttttttttttcagatagg

SEQ ID NO: 9088 - DNA, 23 bp, Artificial Sequence
  Synthetic
ccgttttttttttttcacatagg

SEQ ID NO: 9089 - DNA, 23 bp, Artificial Sequence
  Synthetic
ccgttttttttttttacgcgtat

SEQ ID NO: 9090 - DNA, 23 bp, Artificial Sequence
  Synthetic
ccgttttttttttttggcctgat

SEQ ID NO: 9091 - DNA, 23 bp, Artificial Sequence
  Synthetic
ccgttttttttttttagacacat

SEQ ID NO: 9092 - DNA, 23 bp, Artificial Sequence
  Synthetic
ccgttttttttttttctaccata

SEQ ID NO: 9093 - DNA, 23 bp, Artificial Sequence
  Synthetic
ccgttttttttttttgtccgtgg

SEQ ID NO: 9094 - DNA, 23 bp, Artificial Sequence
  Synthetic
ccgttttttttttttgcatcgtt

SEQ ID NO: 9095 - DNA, 23 bp, Artificial Sequence
  Synthetic
ccgttttttttttttccataaag

SEQ ID NO: 9096 - DNA, 23 bp, Artificial Sequence
  Synthetic
ccgttttttttttttagtagtgc

SEQ ID NO: 9097 - DNA, 23 bp, Artificial Sequence
  Synthetic
ccgttttttttttttagtagtgc

SEQ ID NO: 9098 - DNA, 23 bp, Artificial Sequence
  Synthetic
ccgttttttttttttgagctaca

SEQ ID NO: 9099 - DNA, 23 bp, Artificial Sequence
  Synthetic
ccgttttttttttttagtacatc

SEQ ID NO: 9100 - DNA, 23 bp, Artificial Sequence
  Synthetic
ccgttttttttttttgggattcc

SEQ ID NO: 9101 - DNA, 23 bp, Artificial Sequence
  Synthetic
ccgttttttttttttccatctat

SEQ ID NO: 9102 - DNA, 23 bp, Artificial Sequence
  Synthetic
ccgttttttttttttcacccttg

SEQ ID NO: 9103 - DNA, 23 bp, Artificial Sequence
  Synthetic
ccgttttttttttttacaaagtt

SEQ ID NO: 9104 - DNA, 23 bp, Artificial Sequence
  Synthetic
ccgttttttttttttcactggta

SEQ ID NO: 9105 - DNA, 23 bp, Artificial Sequence
  Synthetic
ccgttttttttttttccaaagtt

SEQ ID NO: 9106 - DNA, 23 bp, Artificial Sequence
  Synthetic
ccgttttttttttttgatcactt

SEQ ID NO: 9107 - DNA, 23 bp, Artificial Sequence
  Synthetic
ccgttttttttttttgctcattt

SEQ ID NO: 9108 - DNA, 23 bp, Artificial Sequence
  Synthetic
ccgttttttttttttgatcattt

SEQ ID NO: 9109 - DNA, 23 bp, Artificial Sequence
  Synthetic
ccgttttttttttttcccctatc

SEQ ID NO: 9110 - DNA, 23 bp, Artificial Sequence
  Synthetic
ccgttttttttttttcacaaacc

SEQ ID NO: 9111 - DNA, 23 bp, Artificial Sequence
  Synthetic
ccgttttttttttttgccgcagc

SEQ ID NO: 9112 - DNA, 23 bp, Artificial Sequence
  Synthetic
ccgttttttttttttacaaacca

SEQ ID NO: 9113 - DNA, 23 bp, Artificial Sequence
  Synthetic
ccgttttttttttttgaaaacca

SEQ ID NO: 9114 - DNA, 23 bp, Artificial Sequence
  Synthetic
ccgttttttttttttcaccaata

SEQ ID NO: 9115 - DNA, 23 bp, Artificial Sequence
  Synthetic
ccgttttttttttttctccaata

SEQ ID NO: 9116 - DNA, 23 bp, Artificial Sequence
  Synthetic
ccgttttttttttttctccaata

SEQ ID NO: 9117 - DNA, 23 bp, Artificial Sequence
  Synthetic
ccgttttttttttttacctgcac

SEQ ID NO: 9118 - DNA, 23 bp, Artificial Sequence
  Synthetic
ccgttttttttttttctagaagt

SEQ ID NO: 9119 - DNA, 23 bp, Artificial Sequence
  Synthetic
ccgttttttttttttactcaccg

SEQ ID NO: 9120 - DNA, 23 bp, Artificial Sequence
  Synthetic
ccgttttttttttttggtacaat

SEQ ID NO: 9121 - DNA, 23 bp, Artificial Sequence
  Synthetic
ccgttttttttttttcccaccga

SEQ ID NO: 9122 - DNA, 23 bp, Artificial Sequence
  Synthetic
ccgttttttttttttcccaccga

SEQ ID NO: 9123 - DNA, 23 bp, Artificial Sequence
  Synthetic
ccgttttttttttttgtgagttc

SEQ ID NO: 9124 - DNA, 23 bp, Artificial Sequence
  Synthetic
ccgttttttttttttagttggca

SEQ ID NO: 9125 - DNA, 23 bp, Artificial Sequence
  Synthetic
ccgttttttttttttcagtgaat

SEQ ID NO: 9126 - DNA, 23 bp, Artificial Sequence
  Synthetic
ccgttttttttttttgcccttat

SEQ ID NO: 9127 - DNA, 23 bp, Artificial Sequence
  Synthetic
ccgttttttttttttggctgcaa

SEQ ID NO: 9128 - DNA, 23 bp, Artificial Sequence
  Synthetic
ccgttttttttttttatctgcac

SEQ ID NO: 9129 - DNA, 23 bp, Artificial Sequence
  Synthetic
ccgttttttttttttatctgcac

SEQ ID NO: 9130 - DNA, 23 bp, Artificial Sequence
  Synthetic
ccgttttttttttttccagaagg

SEQ ID NO: 9131 - DNA, 23 bp, Artificial Sequence
  Synthetic
ccgttttttttttttaactacac

SEQ ID NO: 9132 - DNA, 23 bp, Artificial Sequence
  Synthetic
ccgttttttttttttacctaata

SEQ ID NO: 9133 - DNA, 23 bp, Artificial Sequence
  Synthetic
ccgttttttttttttcaaccgaa

SEQ ID NO: 9134 - DNA, 23 bp, Artificial Sequence
  Synthetic
ccgttttttttttttggctgtca

SEQ ID NO: 9135 - DNA, 23 bp, Artificial Sequence
  Synthetic
ccgttttttttttttactgggac

SEQ ID NO: 9136 - DNA, 23 bp, Artificial Sequence
  Synthetic
ccgttttttttttttagcgggac

SEQ ID NO: 9137 - DNA, 23 bp, Artificial Sequence
  Synthetic
ccgttttttttttttccacatgg

SEQ ID NO: 9138 - DNA, 23 bp, Artificial Sequence
  Synthetic
ccgttttttttttttccacatgg

SEQ ID NO: 9139 - DNA, 23 bp, Artificial Sequence
  Synthetic
ccgttttttttttttcccaacaa

SEQ ID NO: 9140 - DNA, 23 bp, Artificial Sequence
  Synthetic
ccgttttttttttttcccaacaa

SEQ ID NO: 9141 - DNA, 23 bp, Artificial Sequence
  Synthetic
ccgttttttttttttgaacaggt

SEQ ID NO: 9142 - DNA, 23 bp, Artificial Sequence
  Synthetic
ccgttttttttttttaaccaatg

SEQ ID NO: 9143 - DNA, 23 bp, Artificial Sequence
  Synthetic
ccgttttttttttttcagttttg

SEQ ID NO: 9144 - DNA, 23 bp, Artificial Sequence
  Synthetic
ccgttttttttttttagtgcaac

SEQ ID NO: 9145 - DNA, 23 bp, Artificial Sequence
  Synthetic
ccgttttttttttttcagttttg

SEQ ID NO: 9146 - DNA, 23 bp, Artificial Sequence
  Synthetic
ccgttttttttttttctgaatgc

SEQ ID NO: 9147 - DNA, 23 bp, Artificial Sequence
  Synthetic
ccgttttttttttttcgagtttt

SEQ ID NO: 9148 - DNA, 23 bp, Artificial Sequence
  Synthetic
ccgttttttttttttcagttttg

SEQ ID NO: 9149 - DNA, 23 bp, Artificial Sequence
  Synthetic
ccgttttttttttttacatcgtt

SEQ ID NO: 9150 - DNA, 23 bp, Artificial Sequence
  Synthetic
ccgttttttttttttcatcatta

SEQ ID NO: 9151 - DNA, 23 bp, Artificial Sequence
  Synthetic
ccgttttttttttttgcatcatt

SEQ ID NO: 9152 - DNA, 23 bp, Artificial Sequence
  Synthetic
ccgttttttttttttcccatgcc

SEQ ID NO: 9153 - DNA, 23 bp, Artificial Sequence
  Synthetic
ccgttttttttttttcaaagagg

SEQ ID NO: 9154 - DNA, 23 bp, Artificial Sequence
  Synthetic
ccgttttttttttttcaagtggt

SEQ ID NO: 9155 - DNA, 23 bp, Artificial Sequence
  Synthetic
ccgttttttttttttcaagtggt

SEQ ID NO: 9156 - DNA, 23 bp, Artificial Sequence
  Synthetic
ccgttttttttttttgttgaact

SEQ ID NO: 9157 - DNA, 23 bp, Artificial Sequence
  Synthetic
ccgttttttttttttaggcatag

SEQ ID NO: 9158 - DNA, 23 bp, Artificial Sequence
  Synthetic
ccgttttttttttttcagactcc

SEQ ID NO: 9159 - DNA, 23 bp, Artificial Sequence
  Synthetic
ccgttttttttttttccacacac

SEQ ID NO: 9160 - DNA, 23 bp, Artificial Sequence
  Synthetic
ccgttttttttttttctacctgc

SEQ ID NO: 9161 - DNA, 23 bp, Artificial Sequence
  Synthetic
ccgttttttttttttcttcaagt

SEQ ID NO: 9162 - DNA, 23 bp, Artificial Sequence
  Synthetic
ccgttttttttttttctacctgc

SEQ ID NO: 9163 - DNA, 23 bp, Artificial Sequence
  Synthetic
ccgttttttttttttgccaacac

SEQ ID NO: 9164 - DNA, 23 bp, Artificial Sequence
  Synthetic
ccgttttttttttttagccgctg

SEQ ID NO: 9165 - DNA, 23 bp, Artificial Sequence
  Synthetic
ccgttttttttttttcaatgtgc

SEQ ID NO: 9166 - DNA, 23 bp, Artificial Sequence
  Synthetic
ccgttttttttttttagccatga

SEQ ID NO: 9167 - DNA, 23 bp, Artificial Sequence
  Synthetic
ccgttttttttttttctgcctgt

SEQ ID NO: 9168 - DNA, 23 bp, Artificial Sequence
  Synthetic
ccgttttttttttttcacagttg

SEQ ID NO: 9169 - DNA, 23 bp, Artificial Sequence
  Synthetic
ccgttttttttttttcacagttg

SEQ ID NO: 9170 - DNA, 23 bp, Artificial Sequence
  Synthetic
ccgttttttttttttccaatcag

SEQ ID NO: 9171 - DNA, 23 bp, Artificial Sequence
  Synthetic
ccgttttttttttttcacatggt

SEQ ID NO: 9172 - DNA, 23 bp, Artificial Sequence
  Synthetic
ccgttttttttttttgcatggtt

SEQ ID NO: 9173 - DNA, 23 bp, Artificial Sequence
  Synthetic
ccgttttttttttttaagaattg

SEQ ID NO: 9174 - DNA, 23 bp, Artificial Sequence
  Synthetic
ccgttttttttttttaagtgtcc

SEQ ID NO: 9175 - DNA, 23 bp, Artificial Sequence
  Synthetic
ccgttttttttttttgaaaccca

SEQ ID NO: 9176 - DNA, 23 bp, Artificial Sequence
  Synthetic
ccgttttttttttttgagaccca

SEQ ID NO: 9177 - DNA, 23 bp, Artificial Sequence
  Synthetic
ccgttttttttttttggggtatt

SEQ ID NO: 9178 - DNA, 23 bp, Artificial Sequence
  Synthetic
ccgttttttttttttacagttct

SEQ ID NO: 9179 - DNA, 23 bp, Artificial Sequence
  Synthetic
ccgttttttttttttacagctct

SEQ ID NO: 9180 - DNA, 23 bp, Artificial Sequence
  Synthetic
ccgttttttttttttggaaatcc

SEQ ID NO: 9181 - DNA, 23 bp, Artificial Sequence
  Synthetic
ccgttttttttttttggtaatcc

SEQ ID NO: 9182 - DNA, 23 bp, Artificial Sequence
  Synthetic
ccgttttttttttttctgttcct

SEQ ID NO: 9183 - DNA, 23 bp, Artificial Sequence
  Synthetic
ccgttttttttttttcagaccga

SEQ ID NO: 9184 - DNA, 23 bp, Artificial Sequence
  Synthetic
ccgttttttttttttagcctatc

SEQ ID NO: 9185 - DNA, 23 bp, Artificial Sequence
  Synthetic
ccgttttttttttttaacctatc

SEQ ID NO: 9186 - DNA, 23 bp, Artificial Sequence
  Synthetic
ccgttttttttttttagcggaac

SEQ ID NO: 9187 - DNA, 23 bp, Artificial Sequence
  Synthetic
ccgttttttttttttgcagaact

SEQ ID NO: 9188 - DNA, 23 bp, Artificial Sequence
  Synthetic
ccgttttttttttttgcagaact

SEQ ID NO: 9189 - DNA, 23 bp, Artificial Sequence
  Synthetic
ccgttttttttttttcattgttc

SEQ ID NO: 9190 - DNA, 23 bp, Artificial Sequence
  Synthetic
ccgttttttttttttgaagaact

SEQ ID NO: 9191 - DNA, 23 bp, Artificial Sequence
  Synthetic
ccgttttttttttttcactgaac

SEQ ID NO: 9192 - DNA, 23 bp, Artificial Sequence
  Synthetic
ccgttttttttttttaaccgatt

SEQ ID NO: 9193 - DNA, 23 bp, Artificial Sequence
  Synthetic
ccgttttttttttttacactgat

SEQ ID NO: 9194 - DNA, 23 bp, Artificial Sequence
  Synthetic
ccgttttttttttttctttgaca

SEQ ID NO: 9195 - DNA, 23 bp, Artificial Sequence
  Synthetic
ccgttttttttttttcaatgaca

SEQ ID NO: 9196 - DNA, 23 bp, Artificial Sequence
  Synthetic
ccgttttttttttttctatgaca

SEQ ID NO: 9197 - DNA, 23 bp, Artificial Sequence
  Synthetic
ccgttttttttttttcttccagt

SEQ ID NO: 9198 - DNA, 23 bp, Artificial Sequence
  Synthetic
ccgttttttttttttagctgagt

SEQ ID NO: 9199 - DNA, 23 bp, Artificial Sequence
  Synthetic
ccgttttttttttttctgagagt

SEQ ID NO: 9200 - DNA, 23 bp, Artificial Sequence
  Synthetic
ccgttttttttttttcttccagt

SEQ ID NO: 9201 - DNA, 23 bp, Artificial Sequence
  Synthetic
ccgttttttttttttcttccagt

SEQ ID NO: 9202 - DNA, 23 bp, Artificial Sequence
  Synthetic
ccgttttttttttttgctgcaaa

SEQ ID NO: 9203 - DNA, 23 bp, Artificial Sequence
  Synthetic
ccgttttttttttttcagctatg

SEQ ID NO: 9204 - DNA, 23 bp, Artificial Sequence
  Synthetic
ccgttttttttttttcaacaaaa

SEQ ID NO: 9205 - DNA, 23 bp, Artificial Sequence
  Synthetic
ccgttttttttttttacaaccag

SEQ ID NO: 9206 - DNA, 23 bp, Artificial Sequence
  Synthetic
ccgttttttttttttcaatcagc

SEQ ID NO: 9207 - DNA, 23 bp, Artificial Sequence
  Synthetic
ccgttttttttttttgtaatcaa

SEQ ID NO: 9208 - DNA, 23 bp, Artificial Sequence
  Synthetic
ccgttttttttttttacagatgg

SEQ ID NO: 9209 - DNA, 23 bp, Artificial Sequence
  Synthetic
ccgttttttttttttataaggat

SEQ ID NO: 9210 - DNA, 23 bp, Artificial Sequence
  Synthetic
ccgttttttttttttaacgcgag

SEQ ID NO: 9211 - DNA, 23 bp, Artificial Sequence
  Synthetic
ccgttttttttttttacggcatt

SEQ ID NO: 9212 - DNA, 23 bp, Artificial Sequence
  Synthetic
ccgttttttttttttctacccca

SEQ ID NO: 9213 - DNA, 23 bp, Artificial Sequence
  Synthetic
ccgttttttttttttctacccca

SEQ ID NO: 9214 - DNA, 23 bp, Artificial Sequence
  Synthetic
ccgttttttttttttctacccca

SEQ ID NO: 9215 - DNA, 23 bp, Artificial Sequence
  Synthetic
ccgttttttttttttctacgcca

SEQ ID NO: 9216 - DNA, 23 bp, Artificial Sequence
  Synthetic
ccgttttttttttttaccccaat

SEQ ID NO: 9217 - DNA, 23 bp, Artificial Sequence
  Synthetic
ccgttttttttttttaactcagt

SEQ ID NO: 9218 - DNA, 23 bp, Artificial Sequence
  Synthetic
ccgttttttttttttccctatta

SEQ ID NO: 9219 - DNA, 23 bp, Artificial Sequence
  Synthetic
ccgttttttttttttccctataa

SEQ ID NO: 9220 - DNA, 23 bp, Artificial Sequence
  Synthetic
ccgttttttttttttcgatgtag

SEQ ID NO: 9221 - DNA, 23 bp, Artificial Sequence
  Synthetic
ccgttttttttttttgacaacca

SEQ ID NO: 9222 - DNA, 23 bp, Artificial Sequence
  Synthetic
ccgttttttttttttgccaatat

SEQ ID NO: 9223 - DNA, 23 bp, Artificial Sequence
  Synthetic
ccgttttttttttttctccagta

SEQ ID NO: 9224 - DNA, 23 bp, Artificial Sequence
  Synthetic
ccgttttttttttttgcagtacc

SEQ ID NO: 9225 - DNA, 23 bp, Artificial Sequence
  Synthetic
ccgttttttttttttcaggatga

SEQ ID NO: 9226 - DNA, 23 bp, Artificial Sequence
  Synthetic
ccgttttttttttttccccagta

SEQ ID NO: 9227 - DNA, 23 bp, Artificial Sequence
  Synthetic
ccgttttttttttttcatccaca

SEQ ID NO: 9228 - DNA, 23 bp, Artificial Sequence
  Synthetic
ccgttttttttttttcgcacagt

SEQ ID NO: 9229 - DNA, 23 bp, Artificial Sequence
  Synthetic
ccgttttttttttttggcattta

SEQ ID NO: 9230 - DNA, 23 bp, Artificial Sequence
  Synthetic
ccgttttttttttttagctgcat

SEQ ID NO: 9231 - DNA, 23 bp, Artificial Sequence
  Synthetic
ccgttttttttttttgcagccgt

SEQ ID NO: 9232 - DNA, 23 bp, Artificial Sequence
  Synthetic
ccgttttttttttttaaacatca

SEQ ID NO: 9233 - DNA, 23 bp, Artificial Sequence
  Synthetic
ccgttttttttttttaatctgaa

SEQ ID NO: 9234 - DNA, 23 bp, Artificial Sequence
  Synthetic
ccgttttttttttttagcacaga

SEQ ID NO: 9235 - DNA, 23 bp, Artificial Sequence
  Synthetic
ccgttttttttttttaaagtaac

SEQ ID NO: 9236 - DNA, 23 bp, Artificial Sequence
  Synthetic
ccgttttttttttttaacagtcg

SEQ ID NO: 9237 - DNA, 23 bp, Artificial Sequence
  Synthetic
ccgttttttttttttactactag

SEQ ID NO: 9238 - DNA, 23 bp, Artificial Sequence
  Synthetic
ccgttttttttttttccgagttc

SEQ ID NO: 9239 - DNA, 23 bp, Artificial Sequence
  Synthetic
ccgttttttttttttaagtcttc

SEQ ID NO: 9240 - DNA, 23 bp, Artificial Sequence
  Synthetic
ccgttttttttttttgctgggag

SEQ ID NO: 9241 - DNA, 23 bp, Artificial Sequence
  Synthetic
ccgttttttttttttgaaaacgt

SEQ ID NO: 9242 - DNA, 23 bp, Artificial Sequence
  Synthetic
ccgttttttttttttaacccagg

SEQ ID NO: 9243 - DNA, 23 bp, Artificial Sequence
  Synthetic
ccgttttttttttttacacacag

SEQ ID NO: 9244 - DNA, 23 bp, Artificial Sequence
  Synthetic
ccgttttttttttttcgatccgg

SEQ ID NO: 9245 - DNA, 23 bp, Artificial Sequence
  Synthetic
ccgttttttttttttaccgagag

SEQ ID NO: 9246 - DNA, 23 bp, Artificial Sequence
  Synthetic
ccgttttttttttttaaccactg

SEQ ID NO: 9247 - DNA, 23 bp, Artificial Sequence
  Synthetic
ccgttttttttttttcggtacga

SEQ ID NO: 9248 - DNA, 23 bp, Artificial Sequence
  Synthetic
ccgttttttttttttgtcaagtt

SEQ ID NO: 9249 - DNA, 23 bp, Artificial Sequence
  Synthetic
ccgttttttttttttaaaacttt

SEQ ID NO: 9250 - DNA, 23 bp, Artificial Sequence
  Synthetic
ccgttttttttttttattttctt

SEQ ID NO: 9251 - DNA, 23 bp, Artificial Sequence
  Synthetic
ccgttttttttttttgaggtccc

SEQ ID NO: 9252 - DNA, 23 bp, Artificial Sequence
  Synthetic
ccgttttttttttttaacccttc

SEQ ID NO: 9253 - DNA, 23 bp, Artificial Sequence
  Synthetic
ccgttttttttttttactgtacc

SEQ ID NO: 9254 - DNA, 23 bp, Artificial Sequence
  Synthetic
ccgttttttttttttacaacaaa

SEQ ID NO: 9255 - DNA, 23 bp, Artificial Sequence
  Synthetic
ccgttttttttttttaacaaaat

SEQ ID NO: 9256 - DNA, 23 bp, Artificial Sequence
  Synthetic
ccgttttttttttttcatacagc

SEQ ID NO: 9257 - DNA, 23 bp, Artificial Sequence
  Synthetic
ccgttttttttttttactttcgg

SEQ ID NO: 9258 - DNA, 23 bp, Artificial Sequence
  Synthetic
ccgttttttttttttacaggccg

SEQ ID NO: 9259 - DNA, 23 bp, Artificial Sequence
  Synthetic
ccgttttttttttttggaggccg

SEQ ID NO: 9260 - DNA, 23 bp, Artificial Sequence
  Synthetic
ccgttttttttttttacctgcac

SEQ ID NO: 9261 - DNA, 23 bp, Artificial Sequence
  Synthetic
ccgttttttttttttagcaaaaa

SEQ ID NO: 9262 - DNA, 23 bp, Artificial Sequence
  Synthetic
ccgttttttttttttcacaagat

SEQ ID NO: 9263 - DNA, 23 bp, Artificial Sequence
  Synthetic
ccgttttttttttttagacatag

SEQ ID NO: 9264 - DNA, 23 bp, Artificial Sequence
  Synthetic
ccgttttttttttttacagcacg

SEQ ID NO: 9265 - DNA, 23 bp, Artificial Sequence
  Synthetic
ccgttttttttttttacagccaa

SEQ ID NO: 9266 - DNA, 23 bp, Artificial Sequence
  Synthetic
ccgttttttttttttggcagtca

SEQ ID NO: 9267 - DNA, 23 bp, Artificial Sequence
  Synthetic
ccgttttttttttttacaactag

SEQ ID NO: 9268 - DNA, 23 bp, Artificial Sequence
  Synthetic
ccgttttttttttttaaaccaca

SEQ ID NO: 9269 - DNA, 23 bp, Artificial Sequence
  Synthetic
ccgttttttttttttcagccgtc

SEQ ID NO: 9270 - DNA, 23 bp, Artificial Sequence
  Synthetic
ccgttttttttttttatccctac

SEQ ID NO: 9271 - DNA, 23 bp, Artificial Sequence
  Synthetic
ccgttttttttttttgtaaatcg

SEQ ID NO: 9272 - DNA, 23 bp, Artificial Sequence
  Synthetic
ccgttttttttttttctatcaag

SEQ ID NO: 9273 - DNA, 23 bp, Artificial Sequence
  Synthetic
ccgttttttttttttcaagagca

SEQ ID NO: 9274 - DNA, 23 bp, Artificial Sequence
  Synthetic
ccgttttttttttttaaggggac

SEQ ID NO: 9275 - DNA, 23 bp, Artificial Sequence
  Synthetic
ccgttttttttttttccttgtat

SEQ ID NO: 9276 - DNA, 23 bp, Artificial Sequence
  Synthetic
ccgttttttttttttctgtatag

SEQ ID NO: 9277 - DNA, 23 bp, Artificial Sequence
  Synthetic
ccgttttttttttttgcattccc

SEQ ID NO: 9278 - DNA, 23 bp, Artificial Sequence
  Synthetic
ccgttttttttttttgcaagggc

SEQ ID NO: 9279 - DNA, 23 bp, Artificial Sequence
  Synthetic
ccgttttttttttttggtaacag

SEQ ID NO: 9280 - DNA, 23 bp, Artificial Sequence
  Synthetic
ccgttttttttttttggaatgaa

SEQ ID NO: 9281 - DNA, 23 bp, Artificial Sequence
  Synthetic
ccgttttttttttttacacctgg

SEQ ID NO: 9282 - DNA, 23 bp, Artificial Sequence
  Synthetic
ccgttttttttttttagcacaac

SEQ ID NO: 9283 - DNA, 23 bp, Artificial Sequence
  Synthetic
ccgttttttttttttagcacacc

SEQ ID NO: 9284 - DNA, 23 bp, Artificial Sequence
  Synthetic
ccgttttttttttttcgatgggc

SEQ ID NO: 9285 - DNA, 23 bp, Artificial Sequence
  Synthetic
ccgttttttttttttctaaggct

SEQ ID NO: 9286 - DNA, 23 bp, Artificial Sequence
  Synthetic
ccgttttttttttttaagcctat

SEQ ID NO: 9287 - DNA, 23 bp, Artificial Sequence
  Synthetic
ccgttttttttttttccctggac

SEQ ID NO: 9288 - DNA, 23 bp, Artificial Sequence
  Synthetic
ccgttttttttttttctacgacc

SEQ ID NO: 9289 - DNA, 23 bp, Artificial Sequence
  Synthetic
ccgttttttttttttctgtacaa

SEQ ID NO: 9290 - DNA, 23 bp, Artificial Sequence
  Synthetic
ccgttttttttttttctacggga

SEQ ID NO: 9291 - DNA, 23 bp, Artificial Sequence
  Synthetic
ccgttttttttttttaactccgg

SEQ ID NO: 9292 - DNA, 23 bp, Artificial Sequence
  Synthetic
ccgttttttttttttcaatttct

SEQ ID NO: 9293 - DNA, 23 bp, Artificial Sequence
  Synthetic
ccgttttttttttttgctatctg

SEQ ID NO: 9294 - DNA, 23 bp, Artificial Sequence
  Synthetic
ccgttttttttttttgtgtgctt

SEQ ID NO: 9295 - DNA, 23 bp, Artificial Sequence
  Synthetic
ccgttttttttttttaactatac

SEQ ID NO: 9296 - DNA, 23 bp, Artificial Sequence
  Synthetic
ccgttttttttttttaaccacac

SEQ ID NO: 9297 - DNA, 23 bp, Artificial Sequence
  Synthetic
ccgttttttttttttaaccatac

SEQ ID NO: 9298 - DNA, 23 bp, Artificial Sequence
  Synthetic
ccgttttttttttttaactattc

SEQ ID NO: 9299 - DNA, 23 bp, Artificial Sequence
  Synthetic
ccgttttttttttttaactatac

SEQ ID NO: 9300 - DNA, 23 bp, Artificial Sequence
  Synthetic
ccgttttttttttttaacaacac

SEQ ID NO: 9301 - DNA, 23 bp, Artificial Sequence
  Synthetic
ccgttttttttttttaacagcac

SEQ ID NO: 9302 - DNA, 23 bp, Artificial Sequence
  Synthetic
ccgttttttttttttaactgtac

SEQ ID NO: 9303 - DNA, 23 bp, Artificial Sequence
  Synthetic
ccgttttttttttttatacatac

SEQ ID NO: 9304 - DNA, 23 bp, Artificial Sequence
  Synthetic
ccgttttttttttttcacaagtt

SEQ ID NO: 9305 - DNA, 23 bp, Artificial Sequence
  Synthetic
ccgttttttttttttcttcagtt

SEQ ID NO: 9306 - DNA, 23 bp, Artificial Sequence
  Synthetic
ccgttttttttttttcttcagtt

SEQ ID NO: 9307 - DNA, 23 bp, Artificial Sequence
  Synthetic
ccgttttttttttttcatagccc

SEQ ID NO: 9308 - DNA, 23 bp, Artificial Sequence
  Synthetic
ccgttttttttttttgatagccc

SEQ ID NO: 9309 - DNA, 23 bp, Artificial Sequence
  Synthetic
ccgttttttttttttcacaaatt

SEQ ID NO: 9310 - DNA, 23 bp, Artificial Sequence
  Synthetic
ccgttttttttttttacaaatcc

SEQ ID NO: 9311 - DNA, 23 bp, Artificial Sequence
  Synthetic
ccgttttttttttttcacacaca

SEQ ID NO: 9312 - DNA, 23 bp, Artificial Sequence
  Synthetic
ccgttttttttttttcaaacacc

SEQ ID NO: 9313 - DNA, 23 bp, Artificial Sequence
  Synthetic
ccgttttttttttttggcattca

SEQ ID NO: 9314 - DNA, 23 bp, Artificial Sequence
  Synthetic
ccgttttttttttttcacaggtt

SEQ ID NO: 9315 - DNA, 23 bp, Artificial Sequence
  Synthetic
ccgttttttttttttcacaagtt

SEQ ID NO: 9316 - DNA, 23 bp, Artificial Sequence
  Synthetic
ccgttttttttttttgcattatt

SEQ ID NO: 9317 - DNA, 23 bp, Artificial Sequence
  Synthetic
ccgttttttttttttaaaagaga

SEQ ID NO: 9318 - DNA, 23 bp, Artificial Sequence
  Synthetic
ccgttttttttttttagcaagcc

SEQ ID NO: 9319 - DNA, 23 bp, Artificial Sequence
  Synthetic
ccgttttttttttttatgccctt

SEQ ID NO: 9320 - DNA, 23 bp, Artificial Sequence
  Synthetic
ccgttttttttttttcgaccatg

SEQ ID NO: 9321 - DNA, 23 bp, Artificial Sequence
  Synthetic
ccgttttttttttttcagctggt

SEQ ID NO: 9322 - DNA, 23 bp, Artificial Sequence
  Synthetic
ccgttttttttttttcacatagg

SEQ ID NO: 9323 - DNA, 23 bp, Artificial Sequence
  Synthetic
ccgttttttttttttcagatagg

SEQ ID NO: 9324 - DNA, 23 bp, Artificial Sequence
  Synthetic
ccgttttttttttttacgcgtat

SEQ ID NO: 9325 - DNA, 23 bp, Artificial Sequence
  Synthetic
ccgttttttttttttggcctgat

SEQ ID NO: 9326 - DNA, 23 bp, Artificial Sequence
  Synthetic
ccgttttttttttttctaccata

SEQ ID NO: 9327 - DNA, 23 bp, Artificial Sequence
  Synthetic
ccgttttttttttttagtagtgc

SEQ ID NO: 9328 - DNA, 23 bp, Artificial Sequence
  Synthetic
ccgttttttttttttagtagtgc

SEQ ID NO: 9329 - DNA, 23 bp, Artificial Sequence
  Synthetic
ccgttttttttttttagtacatc

SEQ ID NO: 9330 - DNA, 23 bp, Artificial Sequence
  Synthetic
ccgttttttttttttacaaagtt

SEQ ID NO: 9331 - DNA, 23 bp, Artificial Sequence
  Synthetic
ccgttttttttttttacaaagtt

SEQ ID NO: 9332 - DNA, 23 bp, Artificial Sequence
  Synthetic
ccgttttttttttttgatcactt

SEQ ID NO: 9333 - DNA, 23 bp, Artificial Sequence
  Synthetic
ccgttttttttttttgctcattt

SEQ ID NO: 9334 - DNA, 23 bp, Artificial Sequence
  Synthetic
ccgttttttttttttcacaaacc

SEQ ID NO: 9335 - DNA, 23 bp, Artificial Sequence
  Synthetic
ccgttttttttttttacaaacca

SEQ ID NO: 9336 - DNA, 23 bp, Artificial Sequence
  Synthetic
ccgttttttttttttctccaata

SEQ ID NO: 9337 - DNA, 23 bp, Artificial Sequence
  Synthetic
ccgttttttttttttacctgcac

SEQ ID NO: 9338 - DNA, 23 bp, Artificial Sequence
  Synthetic
ccgttttttttttttatctgcac

SEQ ID NO: 9339 - DNA, 23 bp, Artificial Sequence
  Synthetic
ccgttttttttttttactcaccg

SEQ ID NO: 9340 - DNA, 23 bp, Artificial Sequence
  Synthetic
ccgttttttttttttggtacaat

SEQ ID NO: 9341 - DNA, 23 bp, Artificial Sequence
  Synthetic
ccgttttttttttttcccaccga

SEQ ID NO: 9342 - DNA, 23 bp, Artificial Sequence
  Synthetic
ccgttttttttttttagttggca

SEQ ID NO: 9343 - DNA, 23 bp, Artificial Sequence
  Synthetic
ccgttttttttttttcagtgaat

SEQ ID NO: 9344 - DNA, 23 bp, Artificial Sequence
  Synthetic
ccgttttttttttttcccttatc

SEQ ID NO: 9345 - DNA, 23 bp, Artificial Sequence
  Synthetic
ccgttttttttttttggctgcaa

SEQ ID NO: 9346 - DNA, 23 bp, Artificial Sequence
  Synthetic
ccgttttttttttttactgatac

SEQ ID NO: 9347 - DNA, 23 bp, Artificial Sequence
  Synthetic
ccgttttttttttttacctaata

SEQ ID NO: 9348 - DNA, 23 bp, Artificial Sequence
  Synthetic
ccgttttttttttttggctgtca

SEQ ID NO: 9349 - DNA, 23 bp, Artificial Sequence
  Synthetic
ccgttttttttttttactgggac

SEQ ID NO: 9350 - DNA, 23 bp, Artificial Sequence
  Synthetic
ccgttttttttttttccacatgg

SEQ ID NO: 9351 - DNA, 23 bp, Artificial Sequence
  Synthetic
ccgttttttttttttcccaacaa

SEQ ID NO: 9352 - DNA, 23 bp, Artificial Sequence
  Synthetic
ccgttttttttttttcccaacaa

SEQ ID NO: 9353 - DNA, 23 bp, Artificial Sequence
  Synthetic
ccgttttttttttttgaacaggt

SEQ ID NO: 9354 - DNA, 23 bp, Artificial Sequence
  Synthetic
ccgttttttttttttcagttttg

SEQ ID NO: 9355 - DNA, 23 bp, Artificial Sequence
  Synthetic
ccgttttttttttttcagttttg

SEQ ID NO: 9356 - DNA, 23 bp, Artificial Sequence
  Synthetic
ccgttttttttttttctacctgc

SEQ ID NO: 9357 - DNA, 23 bp, Artificial Sequence
  Synthetic
ccgttttttttttttacatcgtt

SEQ ID NO: 9358 - DNA, 23 bp, Artificial Sequence
  Synthetic
ccgttttttttttttcatcatta

SEQ ID NO: 9359 - DNA, 23 bp, Artificial Sequence
  Synthetic
ccgttttttttttttcccatgcc

SEQ ID NO: 9360 - DNA, 23 bp, Artificial Sequence
  Synthetic
ccgttttttttttttcaagtggt

SEQ ID NO: 9361 - DNA, 23 bp, Artificial Sequence
  Synthetic
ccgttttttttttttaggcatag

SEQ ID NO: 9362 - DNA, 23 bp, Artificial Sequence
  Synthetic
ccgttttttttttttcagactcc

SEQ ID NO: 9363 - DNA, 23 bp, Artificial Sequence
  Synthetic
ccgttttttttttttgccaacac

SEQ ID NO: 9364 - DNA, 23 bp, Artificial Sequence
  Synthetic
ccgttttttttttttagccgctg

SEQ ID NO: 9365 - DNA, 23 bp, Artificial Sequence
  Synthetic
ccgttttttttttttagccatga

SEQ ID NO: 9366 - DNA, 23 bp, Artificial Sequence
  Synthetic
ccgttttttttttttctgcctgt

SEQ ID NO: 9367 - DNA, 23 bp, Artificial Sequence
  Synthetic
ccgttttttttttttcacagttg

SEQ ID NO: 9368 - DNA, 23 bp, Artificial Sequence
  Synthetic
ccgttttttttttttcacagttg

SEQ ID NO: 9369 - DNA, 23 bp, Artificial Sequence
  Synthetic
ccgttttttttttttccaatcag

SEQ ID NO: 9370 - DNA, 23 bp, Artificial Sequence
  Synthetic
ccgttttttttttttcacatggt

SEQ ID NO: 9371 - DNA, 23 bp, Artificial Sequence
  Synthetic
ccgttttttttttttgcatggtt

SEQ ID NO: 9372 - DNA, 23 bp, Artificial Sequence
  Synthetic
ccgttttttttttttaagaattg

SEQ ID NO: 9373 - DNA, 23 bp, Artificial Sequence
  Synthetic
ccgttttttttttttgaaaccca

SEQ ID NO: 9374 - DNA, 23 bp, Artificial Sequence
  Synthetic
ccgttttttttttttgagaccca

SEQ ID NO: 9375 - DNA, 23 bp, Artificial Sequence
  Synthetic
ccgttttttttttttggggtatt

SEQ ID NO: 9376 - DNA, 23 bp, Artificial Sequence
  Synthetic
ccgttttttttttttacagttct

SEQ ID NO: 9377 - DNA, 23 bp, Artificial Sequence
  Synthetic
ccgttttttttttttacagctct

SEQ ID NO: 9378 - DNA, 23 bp, Artificial Sequence
  Synthetic
ccgttttttttttttggaaatcc

SEQ ID NO: 9379 - DNA, 23 bp, Artificial Sequence
  Synthetic
ccgttttttttttttggtaatcc

SEQ ID NO: 9380 - DNA, 23 bp, Artificial Sequence
  Synthetic
ccgttttttttttttctgttcct

SEQ ID NO: 9381 - DNA, 23 bp, Artificial Sequence
  Synthetic
ccgttttttttttttcagaccga

SEQ ID NO: 9382 - DNA, 23 bp, Artificial Sequence
  Synthetic
ccgttttttttttttagcctatc

SEQ ID NO: 9383 - DNA, 23 bp, Artificial Sequence
  Synthetic
ccgttttttttttttgcagaact

SEQ ID NO: 9384 - DNA, 23 bp, Artificial Sequence
  Synthetic
ccgttttttttttttgcagaact

SEQ ID NO: 9385 - DNA, 23 bp, Artificial Sequence
  Synthetic
ccgttttttttttttcactgaac

SEQ ID NO: 9386 - DNA, 23 bp, Artificial Sequence
  Synthetic
ccgttttttttttttaaccgatt

SEQ ID NO: 9387 - DNA, 23 bp, Artificial Sequence
  Synthetic
ccgttttttttttttacactgat

SEQ ID NO: 9388 - DNA, 23 bp, Artificial Sequence
  Synthetic
ccgttttttttttttctatgaca

SEQ ID NO: 9389 - DNA, 23 bp, Artificial Sequence
  Synthetic
ccgttttttttttttagctgagt

SEQ ID NO: 9390 - DNA, 23 bp, Artificial Sequence
  Synthetic
ccgttttttttttttccgagagt

SEQ ID NO: 9391 - DNA, 23 bp, Artificial Sequence
  Synthetic
ccgttttttttttttcttccagt

SEQ ID NO: 9392 - DNA, 23 bp, Artificial Sequence
  Synthetic
ccgttttttttttttcaacaaaa

SEQ ID NO: 9393 - DNA, 23 bp, Artificial Sequence
  Synthetic
ccgttttttttttttataaggat

SEQ ID NO: 9394 - DNA, 23 bp, Artificial Sequence
  Synthetic
ccgttttttttttttaacgcgag

SEQ ID NO: 9395 - DNA, 23 bp, Artificial Sequence
  Synthetic
ccgttttttttttttacggcatt

SEQ ID NO: 9396 - DNA, 23 bp, Artificial Sequence
  Synthetic
ccgttttttttttttcgatgtag

SEQ ID NO: 9397 - DNA, 23 bp, Artificial Sequence
  Synthetic
ccgttttttttttttgcagtacc

SEQ ID NO: 9398 - DNA, 23 bp, Artificial Sequence
  Synthetic
ccgttttttttttttcatccaca

SEQ ID NO: 9399 - DNA, 23 bp, Artificial Sequence
  Synthetic
ccgttttttttttttgcagccgt

SEQ ID NO: 9400 - DNA, 23 bp, Artificial Sequence
  Synthetic
ccgttttttttttttaacaaaat

SEQ ID NO: 9401 - DNA, 23 bp, Artificial Sequence
  Synthetic
ccgttttttttttttcatacagc

SEQ ID NO: 9402 - DNA, 23 bp, Artificial Sequence
  Synthetic
ccgttttttttttttacaggccg

SEQ ID NO: 9403 - DNA, 23 bp, Artificial Sequence
  Synthetic
ccgttttttttttttagcaaaaa

SEQ ID NO: 9404 - DNA, 23 bp, Artificial Sequence
  Synthetic
ccgttttttttttttaactatac

SEQ ID NO: 9405 - DNA, 23 bp, Artificial Sequence
  Synthetic
ccgttttttttttttaaccacac

SEQ ID NO: 9406 - DNA, 23 bp, Artificial Sequence
  Synthetic
ccgttttttttttttaaccatac

SEQ ID NO: 9407 - DNA, 23 bp, Artificial Sequence
  Synthetic
ccgttttttttttttactatgca

SEQ ID NO: 9408 - DNA, 23 bp, Artificial Sequence
  Synthetic
ccgttttttttttttaactatac

SEQ ID NO: 9409 - DNA, 23 bp, Artificial Sequence
  Synthetic
ccgttttttttttttactgtaca

SEQ ID NO: 9410 - DNA, 23 bp, Artificial Sequence
  Synthetic
ccgttttttttttttacagcaca

SEQ ID NO: 9411 - DNA, 23 bp, Artificial Sequence
  Synthetic
ccgttttttttttttaactatac

SEQ ID NO: 9412 - DNA, 23 bp, Artificial Sequence
  Synthetic
ccgttttttttttttaactattc

SEQ ID NO: 9413 - DNA, 23 bp, Artificial Sequence
  Synthetic
ccgttttttttttttcacaagtt

SEQ ID NO: 9414 - DNA, 23 bp, Artificial Sequence
  Synthetic
ccgttttttttttttcttcagtt

SEQ ID NO: 9415 - DNA, 23 bp, Artificial Sequence
  Synthetic
ccgttttttttttttcatagccc

SEQ ID NO: 9416 - DNA, 23 bp, Artificial Sequence
  Synthetic
ccgttttttttttttacctgcac

SEQ ID NO: 9417 - DNA, 23 bp, Artificial Sequence
  Synthetic
ccgttttttttttttgatagccc

SEQ ID NO: 9418 - DNA, 23 bp, Artificial Sequence
  Synthetic
ccgttttttttttttacaaattc

SEQ ID NO: 9419 - DNA, 23 bp, Artificial Sequence
  Synthetic
ccgttttttttttttacaaacac

SEQ ID NO: 9420 - DNA, 23 bp, Artificial Sequence
  Synthetic
ccgttttttttttttggcattca

SEQ ID NO: 9421 - DNA, 23 bp, Artificial Sequence
  Synthetic
ccgttttttttttttggcattca

SEQ ID NO: 9422 - DNA, 23 bp, Artificial Sequence
  Synthetic
ccgttttttttttttcacaagtt

SEQ ID NO: 9423 - DNA, 23 bp, Artificial Sequence
  Synthetic
ccgttttttttttttgcgcatta

SEQ ID NO: 9424 - DNA, 23 bp, Artificial Sequence
  Synthetic
ccgttttttttttttcgcgtacc

SEQ ID NO: 9425 - DNA, 23 bp, Artificial Sequence
  Synthetic
ccgttttttttttttaaagagac

SEQ ID NO: 9426 - DNA, 23 bp, Artificial Sequence
  Synthetic
ccgttttttttttttatgccctt

SEQ ID NO: 9427 - DNA, 23 bp, Artificial Sequence
  Synthetic
ccgttttttttttttacgccctt

SEQ ID NO: 9428 - DNA, 23 bp, Artificial Sequence
  Synthetic
ccgttttttttttttacagctgg

SEQ ID NO: 9429 - DNA, 23 bp, Artificial Sequence
  Synthetic
ccgttttttttttttagctggtt

SEQ ID NO: 9430 - DNA, 23 bp, Artificial Sequence
  Synthetic
ccgttttttttttttgcagctgg

SEQ ID NO: 9431 - DNA, 23 bp, Artificial Sequence
  Synthetic
ccgttttttttttttcacatagg

SEQ ID NO: 9432 - DNA, 23 bp, Artificial Sequence
  Synthetic
ccgttttttttttttctacgcgt

SEQ ID NO: 9433 - DNA, 23 bp, Artificial Sequence
  Synthetic
ccgttttttttttttgattcaca

SEQ ID NO: 9434 - DNA, 23 bp, Artificial Sequence
  Synthetic
ccgttttttttttttctaccata

SEQ ID NO: 9435 - DNA, 23 bp, Artificial Sequence
  Synthetic
ccgttttttttttttgtccgtgg

SEQ ID NO: 9436 - DNA, 23 bp, Artificial Sequence
  Synthetic
ccgttttttttttttccataaag

SEQ ID NO: 9437 - DNA, 23 bp, Artificial Sequence
  Synthetic
ccgttttttttttttgtagtgct

SEQ ID NO: 9438 - DNA, 23 bp, Artificial Sequence
  Synthetic
ccgttttttttttttgagtacat

SEQ ID NO: 9439 - DNA, 23 bp, Artificial Sequence
  Synthetic
ccgttttttttttttaacccatg

SEQ ID NO: 9440 - DNA, 23 bp, Artificial Sequence
  Synthetic
ccgttttttttttttcgcctatg

SEQ ID NO: 9441 - DNA, 23 bp, Artificial Sequence
  Synthetic
ccgttttttttttttgcagaact

SEQ ID NO: 9442 - DNA, 23 bp, Artificial Sequence
  Synthetic
ccgttttttttttttgcagaagc

SEQ ID NO: 9443 - DNA, 23 bp, Artificial Sequence
  Synthetic
ccgttttttttttttacaaagtt

SEQ ID NO: 9444 - DNA, 23 bp, Artificial Sequence
  Synthetic
ccgttttttttttttcacttttg

SEQ ID NO: 9445 - DNA, 23 bp, Artificial Sequence
  Synthetic
ccgttttttttttttcccctatc

SEQ ID NO: 9446 - DNA, 23 bp, Artificial Sequence
  Synthetic
ccgttttttttttttacaaacca

SEQ ID NO: 9447 - DNA, 23 bp, Artificial Sequence
  Synthetic
ccgttttttttttttgcaaacca

SEQ ID NO: 9448 - DNA, 23 bp, Artificial Sequence
  Synthetic
ccgttttttttttttcaccaata

SEQ ID NO: 9449 - DNA, 23 bp, Artificial Sequence
  Synthetic
ccgttttttttttttacaagtgc

SEQ ID NO: 9450 - DNA, 23 bp, Artificial Sequence
  Synthetic
ccgttttttttttttactacctg

SEQ ID NO: 9451 - DNA, 23 bp, Artificial Sequence
  Synthetic
ccgttttttttttttactcaccg

SEQ ID NO: 9452 - DNA, 23 bp, Artificial Sequence
  Synthetic
ccgttttttttttttggtacaat

SEQ ID NO: 9453 - DNA, 23 bp, Artificial Sequence
  Synthetic
ccgttttttttttttcccaccga

SEQ ID NO: 9454 - DNA, 23 bp, Artificial Sequence
  Synthetic
ccgttttttttttttcagtgaat

SEQ ID NO: 9455 - DNA, 23 bp, Artificial Sequence
  Synthetic
ccgttttttttttttacccttat

SEQ ID NO: 9456 - DNA, 23 bp, Artificial Sequence
  Synthetic
ccgttttttttttttggctgcaa

SEQ ID NO: 9457 - DNA, 23 bp, Artificial Sequence
  Synthetic
ccgttttttttttttatctgcac

SEQ ID NO: 9458 - DNA, 23 bp, Artificial Sequence
  Synthetic
ccgttttttttttttaactgcac

SEQ ID NO: 9459 - DNA, 23 bp, Artificial Sequence
  Synthetic
ccgttttttttttttacctaata

SEQ ID NO: 9460 - DNA, 23 bp, Artificial Sequence
  Synthetic
ccgttttttttttttaaagcggg

SEQ ID NO: 9461 - DNA, 23 bp, Artificial Sequence
  Synthetic
ccgttttttttttttccacatgg

SEQ ID NO: 9462 - DNA, 23 bp, Artificial Sequence
  Synthetic
ccgttttttttttttccaacaac

SEQ ID NO: 9463 - DNA, 23 bp, Artificial Sequence
  Synthetic
ccgttttttttttttgaacaggt

SEQ ID NO: 9464 - DNA, 23 bp, Artificial Sequence
  Synthetic
ccgttttttttttttccaatgtg

SEQ ID NO: 9465 - DNA, 23 bp, Artificial Sequence
  Synthetic
ccgttttttttttttcagttttg

SEQ ID NO: 9466 - DNA, 23 bp, Artificial Sequence
  Synthetic
ccgttttttttttttcagttttg

SEQ ID NO: 9467 - DNA, 23 bp, Artificial Sequence
  Synthetic
ccgttttttttttttacatactt

SEQ ID NO: 9468 - DNA, 23 bp, Artificial Sequence
  Synthetic
ccgttttttttttttacatactt

SEQ ID NO: 9469 - DNA, 23 bp, Artificial Sequence
  Synthetic
ccgttttttttttttacatcgtt

SEQ ID NO: 9470 - DNA, 23 bp, Artificial Sequence
  Synthetic
ccgttttttttttttatcatcat

SEQ ID NO: 9471 - DNA, 23 bp, Artificial Sequence
  Synthetic
ccgttttttttttttcccatgct

SEQ ID NO: 9472 - DNA, 23 bp, Artificial Sequence
  Synthetic
ccgttttttttttttaaagaagt

SEQ ID NO: 9473 - DNA, 23 bp, Artificial Sequence
  Synthetic
ccgttttttttttttcaagtggt

SEQ ID NO: 9474 - DNA, 23 bp, Artificial Sequence
  Synthetic
ccgttttttttttttaggcatag

SEQ ID NO: 9475 - DNA, 23 bp, Artificial Sequence
  Synthetic
ccgttttttttttttcagactcc

SEQ ID NO: 9476 - DNA, 23 bp, Artificial Sequence
  Synthetic
ccgttttttttttttcagattcc

SEQ ID NO: 9477 - DNA, 23 bp, Artificial Sequence
  Synthetic
ccgttttttttttttccacacac

SEQ ID NO: 9478 - DNA, 23 bp, Artificial Sequence
  Synthetic
ccgttttttttttttctacctgc

SEQ ID NO: 9479 - DNA, 23 bp, Artificial Sequence
  Synthetic
ccgttttttttttttctacctgc

SEQ ID NO: 9480 - DNA, 23 bp, Artificial Sequence
  Synthetic
ccgttttttttttttcaacatca

SEQ ID NO: 9481 - DNA, 23 bp, Artificial Sequence
  Synthetic
ccgttttttttttttaggcatag

SEQ ID NO: 9482 - DNA, 23 bp, Artificial Sequence
  Synthetic
ccgttttttttttttgtctgtca

SEQ ID NO: 9483 - DNA, 23 bp, Artificial Sequence
  Synthetic
ccgttttttttttttcacagttg

SEQ ID NO: 9484 - DNA, 23 bp, Artificial Sequence
  Synthetic
ccgttttttttttttatccaatc

SEQ ID NO: 9485 - DNA, 23 bp, Artificial Sequence
  Synthetic
ccgttttttttttttacatggtt

SEQ ID NO: 9486 - DNA, 23 bp, Artificial Sequence
  Synthetic
ccgttttttttttttagaattgc

SEQ ID NO: 9487 - DNA, 23 bp, Artificial Sequence
  Synthetic
ccgttttttttttttgaaaccca

SEQ ID NO: 9488 - DNA, 23 bp, Artificial Sequence
  Synthetic
ccgttttttttttttgagaccca

SEQ ID NO: 9489 - DNA, 23 bp, Artificial Sequence
  Synthetic
ccgttttttttttttgagaccca

SEQ ID NO: 9490 - DNA, 23 bp, Artificial Sequence
  Synthetic
ccgttttttttttttggggtatt

SEQ ID NO: 9491 - DNA, 23 bp, Artificial Sequence
  Synthetic
ccgttttttttttttggtaatcc

SEQ ID NO: 9492 - DNA, 23 bp, Artificial Sequence
  Synthetic
ccgttttttttttttctgttcct

SEQ ID NO: 9493 - DNA, 23 bp, Artificial Sequence
  Synthetic
ccgttttttttttttgcctatcc

SEQ ID NO: 9494 - DNA, 23 bp, Artificial Sequence
  Synthetic
ccgttttttttttttgcagaact

SEQ ID NO: 9495 - DNA, 23 bp, Artificial Sequence
  Synthetic
ccgttttttttttttaaccgatt

SEQ ID NO: 9496 - DNA, 23 bp, Artificial Sequence
  Synthetic
ccgttttttttttttaacactga

SEQ ID NO: 9497 - DNA, 23 bp, Artificial Sequence
  Synthetic
ccgttttttttttttaccgattt

SEQ ID NO: 9498 - DNA, 23 bp, Artificial Sequence
  Synthetic
ccgttttttttttttatgctttg

SEQ ID NO: 9499 - DNA, 23 bp, Artificial Sequence
  Synthetic
ccgttttttttttttcactaaaa

SEQ ID NO: 9500 - DNA, 23 bp, Artificial Sequence
  Synthetic
ccgttttttttttttctactaaa

SEQ ID NO: 9501 - DNA, 23 bp, Artificial Sequence
  Synthetic
ccgttttttttttttagaaagca

SEQ ID NO: 9502 - DNA, 23 bp, Artificial Sequence
  Synthetic
ccgttttttttttttccactgaa

SEQ ID NO: 9503 - DNA, 23 bp, Artificial Sequence
  Synthetic
ccgttttttttttttcagcaggt

SEQ ID NO: 9504 - DNA, 23 bp, Artificial Sequence
  Synthetic
ccgttttttttttttcaactaaa

SEQ ID NO: 9505 - DNA, 23 bp, Artificial Sequence
  Synthetic
ccgttttttttttttgctgcaaa

SEQ ID NO: 9506 - DNA, 23 bp, Artificial Sequence
  Synthetic
ccgttttttttttttcttccagt

SEQ ID NO: 9507 - DNA, 23 bp, Artificial Sequence
  Synthetic
ccgttttttttttttagctgagt

SEQ ID NO: 9508 - DNA, 23 bp, Artificial Sequence
  Synthetic
ccgttttttttttttagctgaga

SEQ ID NO: 9509 - DNA, 23 bp, Artificial Sequence
  Synthetic
ccgttttttttttttcttccagt

SEQ ID NO: 9510 - DNA, 23 bp, Artificial Sequence
  Synthetic
ccgttttttttttttccagtcaa

SEQ ID NO: 9511 - DNA, 23 bp, Artificial Sequence
  Synthetic
ccgttttttttttttcagctatg

SEQ ID NO: 9512 - DNA, 23 bp, Artificial Sequence
  Synthetic
ccgttttttttttttgcaactta

SEQ ID NO: 9513 - DNA, 23 bp, Artificial Sequence
  Synthetic
ccgttttttttttttcaatgcaa

SEQ ID NO: 9514 - DNA, 23 bp, Artificial Sequence
  Synthetic
ccgttttttttttttaacaacca

SEQ ID NO: 9515 - DNA, 23 bp, Artificial Sequence
  Synthetic
ccgttttttttttttcaatcagc

SEQ ID NO: 9516 - DNA, 23 bp, Artificial Sequence
  Synthetic
ccgttttttttttttgcaatcag

SEQ ID NO: 9517 - DNA, 23 bp, Artificial Sequence
  Synthetic
ccgttttttttttttataaggat

SEQ ID NO: 9518 - DNA, 23 bp, Artificial Sequence
  Synthetic
ccgttttttttttttcaccattg

SEQ ID NO: 9519 - DNA, 23 bp, Artificial Sequence
  Synthetic
ccgttttttttttttaacgcgag

SEQ ID NO: 9520 - DNA, 23 bp, Artificial Sequence
  Synthetic
ccgttttttttttttagccacaa

SEQ ID NO: 9521 - DNA, 23 bp, Artificial Sequence
  Synthetic
ccgttttttttttttacggcatt

SEQ ID NO: 9522 - DNA, 23 bp, Artificial Sequence
  Synthetic
ccgttttttttttttaccagcta

SEQ ID NO: 9523 - DNA, 23 bp, Artificial Sequence
  Synthetic
ccgttttttttttttaaactcag

SEQ ID NO: 9524 - DNA, 23 bp, Artificial Sequence
  Synthetic
ccgttttttttttttcgatgtag

SEQ ID NO: 9525 - DNA, 23 bp, Artificial Sequence
  Synthetic
ccgttttttttttttgacaacca

SEQ ID NO: 9526 - DNA, 23 bp, Artificial Sequence
  Synthetic
ccgttttttttttttcacacagt

SEQ ID NO: 9527 - DNA, 23 bp, Artificial Sequence
  Synthetic
ccgttttttttttttgtcttatg

SEQ ID NO: 9528 - DNA, 23 bp, Artificial Sequence
  Synthetic
ccgttttttttttttgcagccgt

SEQ ID NO: 9529 - DNA, 23 bp, Artificial Sequence
  Synthetic
ccgttttttttttttcagcatgg

SEQ ID NO: 9530 - DNA, 23 bp, Artificial Sequence
  Synthetic
ccgttttttttttttctaaacat

SEQ ID NO: 9531 - DNA, 23 bp, Artificial Sequence
  Synthetic
ccgttttttttttttcaacaaaa

SEQ ID NO: 9532 - DNA, 23 bp, Artificial Sequence
  Synthetic
ccgttttttttttttgaatccca

SEQ ID NO: 9533 - DNA, 23 bp, Artificial Sequence
  Synthetic
ccgttttttttttttaacaaaaa

SEQ ID NO: 9534 - DNA, 23 bp, Artificial Sequence
  Synthetic
ccgttttttttttttcatacagc

SEQ ID NO: 9535 - DNA, 23 bp, Artificial Sequence
  Synthetic
ccgttttttttttttacattcgg

SEQ ID NO: 9536 - DNA, 23 bp, Artificial Sequence
  Synthetic
ccgttttttttttttcaggccgg

SEQ ID NO: 9537 - DNA, 23 bp, Artificial Sequence
  Synthetic
ccgttttttttttttcacaagat

SEQ ID NO: 9538 - DNA, 23 bp, Artificial Sequence
  Synthetic
ccgttttttttttttcacaagtt

SEQ ID NO: 9539 - DNA, 23 bp, Artificial Sequence
  Synthetic
ccgttttttttttttcttcagtt

SEQ ID NO: 9540 - DNA, 23 bp, Artificial Sequence
  Synthetic
ccgttttttttttttcatagccc

SEQ ID NO: 9541 - DNA, 23 bp, Artificial Sequence
  Synthetic
ccgttttttttttttacaggagt

SEQ ID NO: 9542 - DNA, 23 bp, Artificial Sequence
  Synthetic
ccgttttttttttttgctacctg

SEQ ID NO: 9543 - DNA, 23 bp, Artificial Sequence
  Synthetic
ccgttttttttttttatctgcac

SEQ ID NO: 9544 - DNA, 23 bp, Artificial Sequence
  Synthetic
ccgttttttttttttgatagccc

SEQ ID NO: 9545 - DNA, 23 bp, Artificial Sequence
  Synthetic
ccgttttttttttttcacaaatt

SEQ ID NO: 9546 - DNA, 23 bp, Artificial Sequence
  Synthetic
ccgttttttttttttacaaattc

SEQ ID NO: 9547 - DNA, 23 bp, Artificial Sequence
  Synthetic
ccgttttttttttttggcattca

SEQ ID NO: 9548 - DNA, 23 bp, Artificial Sequence
  Synthetic
ccgttttttttttttcacaagtt

SEQ ID NO: 9549 - DNA, 23 bp, Artificial Sequence
  Synthetic
ccgttttttttttttgccctttt

SEQ ID NO: 9550 - DNA, 23 bp, Artificial Sequence
  Synthetic
ccgttttttttttttacagctgg

SEQ ID NO: 9551 - DNA, 23 bp, Artificial Sequence
  Synthetic
ccgttttttttttttccctctgg

SEQ ID NO: 9552 - DNA, 23 bp, Artificial Sequence
  Synthetic
ccgttttttttttttcacatagg

SEQ ID NO: 9553 - DNA, 23 bp, Artificial Sequence
  Synthetic
ccgttttttttttttccatcatc

SEQ ID NO: 9554 - DNA, 23 bp, Artificial Sequence
  Synthetic
ccgttttttttttttccatcttt

SEQ ID NO: 9555 - DNA, 23 bp, Artificial Sequence
  Synthetic
ccgttttttttttttgagctaca

SEQ ID NO: 9556 - DNA, 23 bp, Artificial Sequence
  Synthetic
ccgttttttttttttaagggatt

SEQ ID NO: 9557 - DNA, 23 bp, Artificial Sequence
  Synthetic
ccgttttttttttttcacttttg

SEQ ID NO: 9558 - DNA, 23 bp, Artificial Sequence
  Synthetic
ccgttttttttttttcgaaggca

SEQ ID NO: 9559 - DNA, 23 bp, Artificial Sequence
  Synthetic
ccgttttttttttttcacaaacc

SEQ ID NO: 9560 - DNA, 23 bp, Artificial Sequence
  Synthetic
ccgttttttttttttgtaaacca

SEQ ID NO: 9561 - DNA, 23 bp, Artificial Sequence
  Synthetic
ccgttttttttttttcgccaata

SEQ ID NO: 9562 - DNA, 23 bp, Artificial Sequence
  Synthetic
ccgttttttttttttacaagtgc

SEQ ID NO: 9563 - DNA, 23 bp, Artificial Sequence
  Synthetic
ccgttttttttttttactacctg

SEQ ID NO: 9564 - DNA, 23 bp, Artificial Sequence
  Synthetic
ccgttttttttttttatctgcac

SEQ ID NO: 9565 - DNA, 23 bp, Artificial Sequence
  Synthetic
ccgttttttttttttactcaccg

SEQ ID NO: 9566 - DNA, 23 bp, Artificial Sequence
  Synthetic
ccgttttttttttttggtacaat

SEQ ID NO: 9567 - DNA, 23 bp, Artificial Sequence
  Synthetic
ccgttttttttttttaacccacc

SEQ ID NO: 9568 - DNA, 23 bp, Artificial Sequence
  Synthetic
ccgttttttttttttactcaccg

SEQ ID NO: 9569 - DNA, 23 bp, Artificial Sequence
  Synthetic
ccgttttttttttttcagtgaat

SEQ ID NO: 9570 - DNA, 23 bp, Artificial Sequence
  Synthetic
ccgttttttttttttaagcccaa

SEQ ID NO: 9571 - DNA, 23 bp, Artificial Sequence
  Synthetic
ccgttttttttttttcggctgca

SEQ ID NO: 9572 - DNA, 23 bp, Artificial Sequence
  Synthetic
ccgttttttttttttacctaata

SEQ ID NO: 9573 - DNA, 23 bp, Artificial Sequence
  Synthetic
ccgttttttttttttccacatgg

SEQ ID NO: 9574 - DNA, 23 bp, Artificial Sequence
  Synthetic
ccgttttttttttttgccaatat

SEQ ID NO: 9575 - DNA, 23 bp, Artificial Sequence
  Synthetic
ccgttttttttttttccaacaac

SEQ ID NO: 9576 - DNA, 23 bp, Artificial Sequence
  Synthetic
ccgttttttttttttcctatctc

SEQ ID NO: 9577 - DNA, 23 bp, Artificial Sequence
  Synthetic
ccgttttttttttttgaacaggt

SEQ ID NO: 9578 - DNA, 23 bp, Artificial Sequence
  Synthetic
ccgttttttttttttcagttttg

SEQ ID NO: 9579 - DNA, 23 bp, Artificial Sequence
  Synthetic
ccgttttttttttttcagttttg

SEQ ID NO: 9580 - DNA, 23 bp, Artificial Sequence
  Synthetic
ccgttttttttttttacctgcac

SEQ ID NO: 9581 - DNA, 23 bp, Artificial Sequence
  Synthetic
ccgttttttttttttccatcatt

SEQ ID NO: 9582 - DNA, 23 bp, Artificial Sequence
  Synthetic
ccgttttttttttttaggcatag

SEQ ID NO: 9583 - DNA, 23 bp, Artificial Sequence
  Synthetic
ccgttttttttttttcagactcc

SEQ ID NO: 9584 - DNA, 23 bp, Artificial Sequence
  Synthetic
ccgttttttttttttcaacatca

SEQ ID NO: 9585 - DNA, 23 bp, Artificial Sequence
  Synthetic
ccgttttttttttttctgcctgt

SEQ ID NO: 9586 - DNA, 23 bp, Artificial Sequence
  Synthetic
ccgttttttttttttgtctgtca

SEQ ID NO: 9587 - DNA, 23 bp, Artificial Sequence
  Synthetic
ccgttttttttttttcacagttg

SEQ ID NO: 9588 - DNA, 23 bp, Artificial Sequence
  Synthetic
ccgttttttttttttatccaatc

SEQ ID NO: 9589 - DNA, 23 bp, Artificial Sequence
  Synthetic
ccgttttttttttttacatggtt

SEQ ID NO: 9590 - DNA, 23 bp, Artificial Sequence
  Synthetic
ccgttttttttttttagaattgc

SEQ ID NO: 9591 - DNA, 23 bp, Artificial Sequence
  Synthetic
ccgttttttttttttaaagtgtc

SEQ ID NO: 9592 - DNA, 23 bp, Artificial Sequence
  Synthetic
ccgttttttttttttgaaaccca

SEQ ID NO: 9593 - DNA, 23 bp, Artificial Sequence
  Synthetic
ccgttttttttttttggggtatt

SEQ ID NO: 9594 - DNA, 23 bp, Artificial Sequence
  Synthetic
ccgttttttttttttaaacggaa

SEQ ID NO: 9595 - DNA, 23 bp, Artificial Sequence
  Synthetic
ccgttttttttttttggaaatcc

SEQ ID NO: 9596 - DNA, 23 bp, Artificial Sequence
  Synthetic
ccgttttttttttttctgttcct

SEQ ID NO: 9597 - DNA, 23 bp, Artificial Sequence
  Synthetic
ccgttttttttttttcagaccga

SEQ ID NO: 9598 - DNA, 23 bp, Artificial Sequence
  Synthetic
ccgttttttttttttagcctatc

SEQ ID NO: 9599 - DNA, 23 bp, Artificial Sequence
  Synthetic
ccgttttttttttttggcggaac

SEQ ID NO: 9600 - DNA, 23 bp, Artificial Sequence
  Synthetic
ccgttttttttttttctcaatag

SEQ ID NO: 9601 - DNA, 23 bp, Artificial Sequence
  Synthetic
ccgttttttttttttaaccgatt

SEQ ID NO: 9602 - DNA, 23 bp, Artificial Sequence
  Synthetic
ccgttttttttttttactgattt

SEQ ID NO: 9603 - DNA, 23 bp, Artificial Sequence
  Synthetic
ccgttttttttttttgctgcaaa

SEQ ID NO: 9604 - DNA, 23 bp, Artificial Sequence
  Synthetic
ccgttttttttttttcttccagt

SEQ ID NO: 9605 - DNA, 23 bp, Artificial Sequence
  Synthetic
ccgttttttttttttgctgagtg

SEQ ID NO: 9606 - DNA, 23 bp, Artificial Sequence
  Synthetic
ccgttttttttttttcttccagt

SEQ ID NO: 9607 - DNA, 23 bp, Artificial Sequence
  Synthetic
ccgttttttttttttcagctatg

SEQ ID NO: 9608 - DNA, 23 bp, Artificial Sequence
  Synthetic
ccgttttttttttttgcaactta

SEQ ID NO: 9609 - DNA, 23 bp, Artificial Sequence
  Synthetic
ccgttttttttttttcaatgcaa

SEQ ID NO: 9610 - DNA, 23 bp, Artificial Sequence
  Synthetic
ccgttttttttttttacaaccag

SEQ ID NO: 9611 - DNA, 23 bp, Artificial Sequence
  Synthetic
ccgttttttttttttaacaaaat

SEQ ID NO: 9612 - DNA, 23 bp, Artificial Sequence
  Synthetic
ccgttttttttttttcatacagc

SEQ ID NO: 9613 - DNA, 23 bp, Artificial Sequence
  Synthetic
ccgttttttttttttacaggccg

SEQ ID NO: 9614 - DNA, 23 bp, Artificial Sequence
  Synthetic
ccgttttttttttttctacctgc

SEQ ID NO: 9615 - DNA, 23 bp, Artificial Sequence
  Synthetic
ccgttttttttttttgctcaata

SEQ ID NO: 9616 - DNA, 23 bp, Artificial Sequence
  Synthetic
ccgttttttttttttgcaaaaat

SEQ ID NO: 9617 - DNA, 23 bp, Artificial Sequence
  Synthetic
ccgttttttttttttaacaatac

SEQ ID NO: 9618 - DNA, 23 bp, Artificial Sequence
  Synthetic
ccgttttttttttttcacaagat

SEQ ID NO: 9619 - DNA, 23 bp, Artificial Sequence
  Synthetic
ccgttttttttttttgtgctcac

SEQ ID NO: 9620 - DNA, 23 bp, Artificial Sequence
  Synthetic
ccgttttttttttttgtgctctc

SEQ ID NO: 9621 - DNA, 23 bp, Artificial Sequence
  Synthetic
ccgttttttttttttgtgctctc

SEQ ID NO: 9622 - DNA, 23 bp, Artificial Sequence
  Synthetic
ccgttttttttttttgtgctctc

SEQ ID NO: 9623 - DNA, 23 bp, Artificial Sequence
  Synthetic
ccgttttttttttttgtgctctc

SEQ ID NO: 9624 - DNA, 23 bp, Artificial Sequence
  Synthetic
ccgttttttttttttagagctcc

SEQ ID NO: 9625 - DNA, 23 bp, Artificial Sequence
  Synthetic
ccgttttttttttttggcataca

SEQ ID NO: 9626 - DNA, 23 bp, Artificial Sequence
  Synthetic
ccgttttttttttttggggaatg

SEQ ID NO: 9627 - DNA, 23 bp, Artificial Sequence
  Synthetic
ccgttttttttttttggggaatg

SEQ ID NO: 9628 - DNA, 23 bp, Artificial Sequence
  Synthetic
ccgttttttttttttagatcatg

SEQ ID NO: 9629 - DNA, 23 bp, Artificial Sequence
  Synthetic
ccgttttttttttttagatcatg

SEQ ID NO: 9630 - DNA, 23 bp, Artificial Sequence
  Synthetic
ccgttttttttttttcccgacct

SEQ ID NO: 9631 - DNA, 23 bp, Artificial Sequence
  Synthetic
ccgttttttttttttccggcaag

SEQ ID NO: 9632 - DNA, 23 bp, Artificial Sequence
  Synthetic
ccgttttttttttttatgcagca

SEQ ID NO: 9633 - DNA, 23 bp, Artificial Sequence
  Synthetic
ccgttttttttttttatgcagca

SEQ ID NO: 9634 - DNA, 23 bp, Artificial Sequence
  Synthetic
ccgttttttttttttgggagctc

SEQ ID NO: 9635 - DNA, 23 bp, Artificial Sequence
  Synthetic
ccgttttttttttttgggagctc

SEQ ID NO: 9636 - DNA, 23 bp, Artificial Sequence
  Synthetic
ccgttttttttttttaggagctc

SEQ ID NO: 9637 - DNA, 23 bp, Artificial Sequence
  Synthetic
ccgttttttttttttcagttcaa

SEQ ID NO: 9638 - DNA, 23 bp, Artificial Sequence
  Synthetic
ccgttttttttttttaagttcaa

SEQ ID NO: 9639 - DNA, 23 bp, Artificial Sequence
  Synthetic
ccgttttttttttttaaggggtg

SEQ ID NO: 9640 - DNA, 23 bp, Artificial Sequence
  Synthetic
ccgttttttttttttaaggggtg

SEQ ID NO: 9641 - DNA, 23 bp, Artificial Sequence
  Synthetic
ccgttttttttttttagcctgga

SEQ ID NO: 9642 - DNA, 23 bp, Artificial Sequence
  Synthetic
ccgttttttttttttcggtgaag

SEQ ID NO: 9643 - DNA, 23 bp, Artificial Sequence
  Synthetic
ccgttttttttttttctcacggg

SEQ ID NO: 9644 - DNA, 23 bp, Artificial Sequence
  Synthetic
ccgttttttttttttctacaaac

SEQ ID NO: 9645 - DNA, 23 bp, Artificial Sequence
  Synthetic
ccgttttttttttttctttccag

SEQ ID NO: 9646 - DNA, 23 bp, Artificial Sequence
  Synthetic
ccgttttttttttttccgcgcgc

SEQ ID NO: 9647 - DNA, 23 bp, Artificial Sequence
  Synthetic
ccgttttttttttttctggacga

SEQ ID NO: 9648 - DNA, 23 bp, Artificial Sequence
  Synthetic
ccgttttttttttttggtccgag

SEQ ID NO: 9649 - DNA, 23 bp, Artificial Sequence
  Synthetic
ccgttttttttttttccgcggga

SEQ ID NO: 9650 - DNA, 23 bp, Artificial Sequence
  Synthetic
ccgttttttttttttcatccacc

SEQ ID NO: 9651 - DNA, 23 bp, Artificial Sequence
  Synthetic
ccgttttttttttttcgcccacg

SEQ ID NO: 9652 - DNA, 23 bp, Artificial Sequence
  Synthetic
ccgttttttttttttatccccct

SEQ ID NO: 9653 - DNA, 23 bp, Artificial Sequence
  Synthetic
ccgttttttttttttacgctctc

SEQ ID NO: 9654 - DNA, 23 bp, Artificial Sequence
  Synthetic
ccgttttttttttttgacatcgt

SEQ ID NO: 9655 - DNA, 23 bp, Artificial Sequence
  Synthetic
ccgttttttttttttaactatac

SEQ ID NO: 9656 - DNA, 23 bp, Artificial Sequence
  Synthetic
ccgttttttttttttaaccacac

SEQ ID NO: 9657 - DNA, 23 bp, Artificial Sequence
  Synthetic
ccgttttttttttttaaccatac

SEQ ID NO: 9658 - DNA, 23 bp, Artificial Sequence
  Synthetic
ccgttttttttttttactatgca

SEQ ID NO: 9659 - DNA, 23 bp, Artificial Sequence
  Synthetic
ccgttttttttttttactataca

SEQ ID NO: 9660 - DNA, 23 bp, Artificial Sequence
  Synthetic
ccgttttttttttttaactatac

SEQ ID NO: 9661 - DNA, 23 bp, Artificial Sequence
  Synthetic
ccgttttttttttttactgtaca

SEQ ID NO: 9662 - DNA, 23 bp, Artificial Sequence
  Synthetic
ccgttttttttttttacagcaca

SEQ ID NO: 9663 - DNA, 23 bp, Artificial Sequence
  Synthetic
ccgttttttttttttacatactt

SEQ ID NO: 9664 - DNA, 23 bp, Artificial Sequence
  Synthetic
ccgttttttttttttcacaagtt

SEQ ID NO: 9665 - DNA, 23 bp, Artificial Sequence
  Synthetic
ccgttttttttttttcttcagtt

SEQ ID NO: 9666 - DNA, 23 bp, Artificial Sequence
  Synthetic
ccgttttttttttttcatagccc

SEQ ID NO: 9667 - DNA, 23 bp, Artificial Sequence
  Synthetic
ccgttttttttttttacaggagt

SEQ ID NO: 9668 - DNA, 23 bp, Artificial Sequence
  Synthetic
ccgttttttttttttgctacctg

SEQ ID NO: 9669 - DNA, 23 bp, Artificial Sequence
  Synthetic
ccgttttttttttttatctgcac

SEQ ID NO: 9670 - DNA, 23 bp, Artificial Sequence
  Synthetic
ccgttttttttttttgatagccc

SEQ ID NO: 9671 - DNA, 23 bp, Artificial Sequence
  Synthetic
ccgttttttttttttcacaaatt

SEQ ID NO: 9672 - DNA, 23 bp, Artificial Sequence
  Synthetic
ccgttttttttttttacaaattc

SEQ ID NO: 9673 - DNA, 23 bp, Artificial Sequence
  Synthetic
ccgttttttttttttacaaacac

SEQ ID NO: 9674 - DNA, 23 bp, Artificial Sequence
  Synthetic
ccgttttttttttttggcattca

SEQ ID NO: 9675 - DNA, 23 bp, Artificial Sequence
  Synthetic
ccgttttttttttttcacaggtt

SEQ ID NO: 9676 - DNA, 23 bp, Artificial Sequence
  Synthetic
ccgttttttttttttcacaagtt

SEQ ID NO: 9677 - DNA, 23 bp, Artificial Sequence
  Synthetic
ccgttttttttttttgcattatt

SEQ ID NO: 9678 - DNA, 23 bp, Artificial Sequence
  Synthetic
ccgttttttttttttcgcgtacc

SEQ ID NO: 9679 - DNA, 23 bp, Artificial Sequence
  Synthetic
ccgttttttttttttagccaagc

SEQ ID NO: 9680 - DNA, 23 bp, Artificial Sequence
  Synthetic
ccgttttttttttttaaaagaga

SEQ ID NO: 9681 - DNA, 23 bp, Artificial Sequence
  Synthetic
ccgttttttttttttgaaagaga

SEQ ID NO: 9682 - DNA, 23 bp, Artificial Sequence
  Synthetic
ccgttttttttttttgcaagccc

SEQ ID NO: 9683 - DNA, 23 bp, Artificial Sequence
  Synthetic
ccgttttttttttttatgccctt

SEQ ID NO: 9684 - DNA, 23 bp, Artificial Sequence
  Synthetic
ccgttttttttttttatgccctt

SEQ ID NO: 9685 - DNA, 23 bp, Artificial Sequence
  Synthetic
ccgttttttttttttcgaccatg

SEQ ID NO: 9686 - DNA, 23 bp, Artificial Sequence
  Synthetic
ccgttttttttttttacagctgg

SEQ ID NO: 9687 - DNA, 23 bp, Artificial Sequence
  Synthetic
ccgttttttttttttagctggtt

SEQ ID NO: 9688 - DNA, 23 bp, Artificial Sequence
  Synthetic
ccgttttttttttttccctctgg

SEQ ID NO: 9689 - DNA, 23 bp, Artificial Sequence
  Synthetic
ccgttttttttttttcacatagg

SEQ ID NO: 9690 - DNA, 23 bp, Artificial Sequence
  Synthetic
ccgttttttttttttcacatagg

SEQ ID NO: 9691 - DNA, 23 bp, Artificial Sequence
  Synthetic
ccgttttttttttttccatcatc

SEQ ID NO: 9692 - DNA, 23 bp, Artificial Sequence
  Synthetic
ccgttttttttttttctacgcgt

SEQ ID NO: 9693 - DNA, 23 bp, Artificial Sequence
  Synthetic
ccgttttttttttttgattcaca

SEQ ID NO: 9694 - DNA, 23 bp, Artificial Sequence
  Synthetic
ccgttttttttttttagacacgt

SEQ ID NO: 9695 - DNA, 23 bp, Artificial Sequence
  Synthetic
ccgttttttttttttctaccata

SEQ ID NO: 9696 - DNA, 23 bp, Artificial Sequence
  Synthetic
ccgttttttttttttccatcttt

SEQ ID NO: 9697 - DNA, 23 bp, Artificial Sequence
  Synthetic
ccgttttttttttttccataaag

SEQ ID NO: 9698 - DNA, 23 bp, Artificial Sequence
  Synthetic
ccgttttttttttttgtagtgct

SEQ ID NO: 9699 - DNA, 23 bp, Artificial Sequence
  Synthetic
ccgttttttttttttgagctaca

SEQ ID NO: 9700 - DNA, 23 bp, Artificial Sequence
  Synthetic
ccgttttttttttttctagtaca

SEQ ID NO: 9701 - DNA, 23 bp, Artificial Sequence
  Synthetic
ccgttttttttttttaagggatt

SEQ ID NO: 9702 - DNA, 23 bp, Artificial Sequence
  Synthetic
ccgttttttttttttaacccatg

SEQ ID NO: 9703 - DNA, 23 bp, Artificial Sequence
  Synthetic
ccgttttttttttttagcctatg

SEQ ID NO: 9704 - DNA, 23 bp, Artificial Sequence
  Synthetic
ccgttttttttttttgcagaagc

SEQ ID NO: 9705 - DNA, 23 bp, Artificial Sequence
  Synthetic
ccgttttttttttttacaaagtt

SEQ ID NO: 9706 - DNA, 23 bp, Artificial Sequence
  Synthetic
ccgttttttttttttacaaagtt

SEQ ID NO: 9707 - DNA, 23 bp, Artificial Sequence
  Synthetic
ccgttttttttttttggagtgaa

SEQ ID NO: 9708 - DNA, 23 bp, Artificial Sequence
  Synthetic
ccgttttttttttttcactggta

SEQ ID NO: 9709 - DNA, 23 bp, Artificial Sequence
  Synthetic
ccgttttttttttttcctcaagg

SEQ ID NO: 9710 - DNA, 23 bp, Artificial Sequence
  Synthetic
ccgttttttttttttcccaagtt

SEQ ID NO: 9711 - DNA, 23 bp, Artificial Sequence
  Synthetic
ccgttttttttttttcacttttg

SEQ ID NO: 9712 - DNA, 23 bp, Artificial Sequence
  Synthetic
ccgttttttttttttcgaaggca

SEQ ID NO: 9713 - DNA, 23 bp, Artificial Sequence
  Synthetic
ccgttttttttttttaataggtc

SEQ ID NO: 9714 - DNA, 23 bp, Artificial Sequence
  Synthetic
ccgttttttttttttcccctatc

SEQ ID NO: 9715 - DNA, 23 bp, Artificial Sequence
  Synthetic
ccgttttttttttttcacaaacc

SEQ ID NO: 9716 - DNA, 23 bp, Artificial Sequence
  Synthetic
ccgttttttttttttgtaaacca

SEQ ID NO: 9717 - DNA, 23 bp, Artificial Sequence
  Synthetic
ccgttttttttttttcgccaata

SEQ ID NO: 9718 - DNA, 23 bp, Artificial Sequence
  Synthetic
ccgttttttttttttacaagtgc

SEQ ID NO: 9719 - DNA, 23 bp, Artificial Sequence
  Synthetic
ccgttttttttttttactacctg

SEQ ID NO: 9720 - DNA, 23 bp, Artificial Sequence
  Synthetic
ccgttttttttttttactcaccg

SEQ ID NO: 9721 - DNA, 23 bp, Artificial Sequence
  Synthetic
ccgttttttttttttggtacaat

SEQ ID NO: 9722 - DNA, 23 bp, Artificial Sequence
  Synthetic
ccgttttttttttttcccaccga

SEQ ID NO: 9723 - DNA, 23 bp, Artificial Sequence
  Synthetic
ccgttttttttttttactcaccg

SEQ ID NO: 9724 - DNA, 23 bp, Artificial Sequence
  Synthetic
ccgttttttttttttaacccacc

SEQ ID NO: 9725 - DNA, 23 bp, Artificial Sequence
  Synthetic
ccgttttttttttttgtgagttc

SEQ ID NO: 9726 - DNA, 23 bp, Artificial Sequence
  Synthetic
ccgttttttttttttagttggca

SEQ ID NO: 9727 - DNA, 23 bp, Artificial Sequence
  Synthetic
ccgttttttttttttcagtgaat

SEQ ID NO: 9728 - DNA, 23 bp, Artificial Sequence
  Synthetic
ccgttttttttttttacccttat

SEQ ID NO: 9729 - DNA, 23 bp, Artificial Sequence
  Synthetic
ccgttttttttttttgaactgcc

SEQ ID NO: 9730 - DNA, 23 bp, Artificial Sequence
  Synthetic
ccgttttttttttttaagcccaa

SEQ ID NO: 9731 - DNA, 23 bp, Artificial Sequence
  Synthetic
ccgttttttttttttcggctgca

SEQ ID NO: 9732 - DNA, 23 bp, Artificial Sequence
  Synthetic
ccgttttttttttttaccctcca

SEQ ID NO: 9733 - DNA, 23 bp, Artificial Sequence
  Synthetic
ccgttttttttttttactgatat

SEQ ID NO: 9734 - DNA, 23 bp, Artificial Sequence
  Synthetic
ccgttttttttttttatctgcac

SEQ ID NO: 9735 - DNA, 23 bp, Artificial Sequence
  Synthetic
ccgttttttttttttagaaggag

SEQ ID NO: 9736 - DNA, 23 bp, Artificial Sequence
  Synthetic
ccgttttttttttttaactgcac

SEQ ID NO: 9737 - DNA, 23 bp, Artificial Sequence
  Synthetic
ccgttttttttttttacctaata

SEQ ID NO: 9738 - DNA, 23 bp, Artificial Sequence
  Synthetic
ccgttttttttttttagctgctt

SEQ ID NO: 9739 - DNA, 23 bp, Artificial Sequence
  Synthetic
ccgttttttttttttggggacga

SEQ ID NO: 9740 - DNA, 23 bp, Artificial Sequence
  Synthetic
ccgttttttttttttggctgtca

SEQ ID NO: 9741 - DNA, 23 bp, Artificial Sequence
  Synthetic
ccgttttttttttttctgggact

SEQ ID NO: 9742 - DNA, 23 bp, Artificial Sequence
  Synthetic
ccgttttttttttttaaagcggg

SEQ ID NO: 9743 - DNA, 23 bp, Artificial Sequence
  Synthetic
ccgttttttttttttccacatgg

SEQ ID NO: 9744 - DNA, 23 bp, Artificial Sequence
  Synthetic
ccgttttttttttttgccaatat

SEQ ID NO: 9745 - DNA, 23 bp, Artificial Sequence
  Synthetic
ccgttttttttttttccaacaac

SEQ ID NO: 9746 - DNA, 23 bp, Artificial Sequence
  Synthetic
ccgttttttttttttccaacaac

SEQ ID NO: 9747 - DNA, 23 bp, Artificial Sequence
  Synthetic
ccgttttttttttttgctgggtg

SEQ ID NO: 9748 - DNA, 23 bp, Artificial Sequence
  Synthetic
ccgttttttttttttcctatctc

SEQ ID NO: 9749 - DNA, 23 bp, Artificial Sequence
  Synthetic
ccgttttttttttttgaacaggt

SEQ ID NO: 9750 - DNA, 23 bp, Artificial Sequence
  Synthetic
ccgttttttttttttaaccaatg

SEQ ID NO: 9751 - DNA, 23 bp, Artificial Sequence
  Synthetic
ccgttttttttttttgaacagat

SEQ ID NO: 9752 - DNA, 23 bp, Artificial Sequence
  Synthetic
ccgttttttttttttcagttttg

SEQ ID NO: 9753 - DNA, 23 bp, Artificial Sequence
  Synthetic
ccgttttttttttttcagttttg

SEQ ID NO: 9754 - DNA, 23 bp, Artificial Sequence
  Synthetic
ccgttttttttttttacatcgtt

SEQ ID NO: 9755 - DNA, 23 bp, Artificial Sequence
  Synthetic
ccgttttttttttttccagcact

SEQ ID NO: 9756 - DNA, 23 bp, Artificial Sequence
  Synthetic
ccgttttttttttttgtcatcat

SEQ ID NO: 9757 - DNA, 23 bp, Artificial Sequence
  Synthetic
ccgttttttttttttccatcatt

SEQ ID NO: 9758 - DNA, 23 bp, Artificial Sequence
  Synthetic
ccgttttttttttttcccatgcc

SEQ ID NO: 9759 - DNA, 23 bp, Artificial Sequence
  Synthetic
ccgttttttttttttaaagaagt

SEQ ID NO: 9760 - DNA, 23 bp, Artificial Sequence
  Synthetic
ccgttttttttttttctagtggt

SEQ ID NO: 9761 - DNA, 23 bp, Artificial Sequence
  Synthetic
ccgttttttttttttaggcatag

SEQ ID NO: 9762 - DNA, 23 bp, Artificial Sequence
  Synthetic
ccgttttttttttttcagactcc

SEQ ID NO: 9763 - DNA, 23 bp, Artificial Sequence
  Synthetic
ccgttttttttttttccacacac

SEQ ID NO: 9764 - DNA, 23 bp, Artificial Sequence
  Synthetic
ccgttttttttttttacaagctt

SEQ ID NO: 9765 - DNA, 23 bp, Artificial Sequence
  Synthetic
ccgttttttttttttctacctgc

SEQ ID NO: 9766 - DNA, 23 bp, Artificial Sequence
  Synthetic
ccgttttttttttttctacctgc

SEQ ID NO: 9767 - DNA, 23 bp, Artificial Sequence
  Synthetic
ccgttttttttttttcaacatca

SEQ ID NO: 9768 - DNA, 23 bp, Artificial Sequence
  Synthetic
ccgttttttttttttcagccgct

SEQ ID NO: 9769 - DNA, 23 bp, Artificial Sequence
  Synthetic
ccgttttttttttttaggcgaag

SEQ ID NO: 9770 - DNA, 23 bp, Artificial Sequence
  Synthetic
ccgttttttttttttggccgtga

SEQ ID NO: 9771 - DNA, 23 bp, Artificial Sequence
  Synthetic
ccgttttttttttttctgcctgt

SEQ ID NO: 9772 - DNA, 23 bp, Artificial Sequence
  Synthetic
ccgttttttttttttgtctgtca

SEQ ID NO: 9773 - DNA, 23 bp, Artificial Sequence
  Synthetic
ccgttttttttttttcacagttg

SEQ ID NO: 9774 - DNA, 23 bp, Artificial Sequence
  Synthetic
ccgttttttttttttatccaatc

SEQ ID NO: 9775 - DNA, 23 bp, Artificial Sequence
  Synthetic
ccgttttttttttttacatggtt

SEQ ID NO: 9776 - DNA, 23 bp, Artificial Sequence
  Synthetic
ccgttttttttttttagaattgc

SEQ ID NO: 9777 - DNA, 23 bp, Artificial Sequence
  Synthetic
ccgttttttttttttacagttct

SEQ ID NO: 9778 - DNA, 23 bp, Artificial Sequence
  Synthetic
ccgttttttttttttaaagtgtc

SEQ ID NO: 9779 - DNA, 23 bp, Artificial Sequence
  Synthetic
ccgttttttttttttgaaaccca

SEQ ID NO: 9780 - DNA, 23 bp, Artificial Sequence
  Synthetic
ccgttttttttttttgagaccca

SEQ ID NO: 9781 - DNA, 23 bp, Artificial Sequence
  Synthetic
ccgttttttttttttggggtatt

SEQ ID NO: 9782 - DNA, 23 bp, Artificial Sequence
  Synthetic
ccgttttttttttttaaacggaa

SEQ ID NO: 9783 - DNA, 23 bp, Artificial Sequence
  Synthetic
ccgttttttttttttggaaatcc

SEQ ID NO: 9784 - DNA, 23 bp, Artificial Sequence
  Synthetic
ccgttttttttttttggtaatcc

SEQ ID NO: 9785 - DNA, 23 bp, Artificial Sequence
  Synthetic
ccgttttttttttttctgttcct

SEQ ID NO: 9786 - DNA, 23 bp, Artificial Sequence
  Synthetic
ccgttttttttttttcagaccga

SEQ ID NO: 9787 - DNA, 23 bp, Artificial Sequence
  Synthetic
ccgttttttttttttgcctatcc

SEQ ID NO: 9788 - DNA, 23 bp, Artificial Sequence
  Synthetic
ccgttttttttttttaacctatc

SEQ ID NO: 9789 - DNA, 23 bp, Artificial Sequence
  Synthetic
ccgttttttttttttgcggaact

SEQ ID NO: 9790 - DNA, 23 bp, Artificial Sequence
  Synthetic
ccgttttttttttttgcagaact

SEQ ID NO: 9791 - DNA, 23 bp, Artificial Sequence
  Synthetic
ccgttttttttttttctcaatag

SEQ ID NO: 9792 - DNA, 23 bp, Artificial Sequence
  Synthetic
ccgttttttttttttacaggatt

SEQ ID NO: 9793 - DNA, 23 bp, Artificial Sequence
  Synthetic
ccgttttttttttttaagcggtt

SEQ ID NO: 9794 - DNA, 23 bp, Artificial Sequence
  Synthetic
ccgttttttttttttatgtatgt

SEQ ID NO: 9795 - DNA, 23 bp, Artificial Sequence
  Synthetic
ccgttttttttttttaaccgatt

SEQ ID NO: 9796 - DNA, 23 bp, Artificial Sequence
  Synthetic
ccgttttttttttttaacactga

SEQ ID NO: 9797 - DNA, 23 bp, Artificial Sequence
  Synthetic
ccgttttttttttttaccgattt

SEQ ID NO: 9798 - DNA, 23 bp, Artificial Sequence
  Synthetic
ccgttttttttttttgctttgac

SEQ ID NO: 9799 - DNA, 23 bp, Artificial Sequence
  Synthetic
ccgttttttttttttcaccaaaa

SEQ ID NO: 9800 - DNA, 23 bp, Artificial Sequence
  Synthetic
ccgttttttttttttaaagcaag

SEQ ID NO: 9801 - DNA, 23 bp, Artificial Sequence
  Synthetic
ccgttttttttttttctactaaa

SEQ ID NO: 9802 - DNA, 23 bp, Artificial Sequence
  Synthetic
ccgttttttttttttagaaagca

SEQ ID NO: 9803 - DNA, 23 bp, Artificial Sequence
  Synthetic
ccgttttttttttttccactgaa

SEQ ID NO: 9804 - DNA, 23 bp, Artificial Sequence
  Synthetic
ccgttttttttttttcagcaggt

SEQ ID NO: 9805 - DNA, 23 bp, Artificial Sequence
  Synthetic
ccgttttttttttttacactcaa

SEQ ID NO: 9806 - DNA, 23 bp, Artificial Sequence
  Synthetic
ccgttttttttttttgctgcaaa

SEQ ID NO: 9807 - DNA, 23 bp, Artificial Sequence
  Synthetic
ccgttttttttttttcttccagt

SEQ ID NO: 9808 - DNA, 23 bp, Artificial Sequence
  Synthetic
ccgttttttttttttagctgagt

SEQ ID NO: 9809 - DNA, 23 bp, Artificial Sequence
  Synthetic
ccgttttttttttttgctgagag

SEQ ID NO: 9810 - DNA, 23 bp, Artificial Sequence
  Synthetic
ccgttttttttttttcttccagt

SEQ ID NO: 9811 - DNA, 23 bp, Artificial Sequence
  Synthetic
ccgttttttttttttgctgtaaa

SEQ ID NO: 9812 - DNA, 23 bp, Artificial Sequence
  Synthetic
ccgttttttttttttccagtcaa

SEQ ID NO: 9813 - DNA, 23 bp, Artificial Sequence
  Synthetic
ccgttttttttttttcagctatg

SEQ ID NO: 9814 - DNA, 23 bp, Artificial Sequence
  Synthetic
ccgttttttttttttgcaactta

SEQ ID NO: 9815 - DNA, 23 bp, Artificial Sequence
  Synthetic
ccgttttttttttttcgccctct

SEQ ID NO: 9816 - DNA, 23 bp, Artificial Sequence
  Synthetic
ccgttttttttttttagaggtcg

SEQ ID NO: 9817 - DNA, 23 bp, Artificial Sequence
  Synthetic
ccgttttttttttttccagcagc

SEQ ID NO: 9818 - DNA, 23 bp, Artificial Sequence
  Synthetic
ccgttttttttttttacaccaat

SEQ ID NO: 9819 - DNA, 23 bp, Artificial Sequence
  Synthetic
ccgttttttttttttacacttac

SEQ ID NO: 9820 - DNA, 23 bp, Artificial Sequence
  Synthetic
ccgttttttttttttctggagga

SEQ ID NO: 9821 - DNA, 23 bp, Artificial Sequence
  Synthetic
ccgttttttttttttacggaagg

SEQ ID NO: 9822 - DNA, 23 bp, Artificial Sequence
  Synthetic
ccgttttttttttttaaagaggt

SEQ ID NO: 9823 - DNA, 23 bp, Artificial Sequence
  Synthetic
ccgttttttttttttcaatgcaa

SEQ ID NO: 9824 - DNA, 23 bp, Artificial Sequence
  Synthetic
ccgttttttttttttctctgcag

SEQ ID NO: 9825 - DNA, 23 bp, Artificial Sequence
  Synthetic
ccgttttttttttttctaggata

SEQ ID NO: 9826 - DNA, 23 bp, Artificial Sequence
  Synthetic
ccgttttttttttttacattttt

SEQ ID NO: 9827 - DNA, 23 bp, Artificial Sequence
  Synthetic
ccgttttttttttttaaaggcat

SEQ ID NO: 9828 - DNA, 23 bp, Artificial Sequence
  Synthetic
ccgttttttttttttcaacaaaa

SEQ ID NO: 9829 - DNA, 23 bp, Artificial Sequence
  Synthetic
ccgttttttttttttgagctcct

SEQ ID NO: 9830 - DNA, 23 bp, Artificial Sequence
  Synthetic
ccgttttttttttttgcaatgca

SEQ ID NO: 9831 - DNA, 23 bp, Artificial Sequence
  Synthetic
ccgttttttttttttggctataa

SEQ ID NO: 9832 - DNA, 23 bp, Artificial Sequence
  Synthetic
ccgttttttttttttgacgggtg

SEQ ID NO: 9833 - DNA, 23 bp, Artificial Sequence
  Synthetic
ccgttttttttttttgccctgga

SEQ ID NO: 9834 - DNA, 23 bp, Artificial Sequence
  Synthetic
ccgttttttttttttagaggcag

SEQ ID NO: 9835 - DNA, 23 bp, Artificial Sequence
  Synthetic
ccgttttttttttttaacaacca

SEQ ID NO: 9836 - DNA, 23 bp, Artificial Sequence
  Synthetic
ccgttttttttttttcaatcagc

SEQ ID NO: 9837 - DNA, 23 bp, Artificial Sequence
  Synthetic
ccgttttttttttttgcaatcag

SEQ ID NO: 9838 - DNA, 23 bp, Artificial Sequence
  Synthetic
ccgttttttttttttgtacccct

SEQ ID NO: 9839 - DNA, 23 bp, Artificial Sequence
  Synthetic
ccgttttttttttttactcacac

SEQ ID NO: 9840 - DNA, 23 bp, Artificial Sequence
  Synthetic
ccgttttttttttttacagatgg

SEQ ID NO: 9841 - DNA, 23 bp, Artificial Sequence
  Synthetic
ccgttttttttttttaaattgca

SEQ ID NO: 9842 - DNA, 23 bp, Artificial Sequence
  Synthetic
ccgttttttttttttataaggat

SEQ ID NO: 9843 - DNA, 23 bp, Artificial Sequence
  Synthetic
ccgttttttttttttcaccattg

SEQ ID NO: 9844 - DNA, 23 bp, Artificial Sequence
  Synthetic
ccgttttttttttttaaacgtgg

SEQ ID NO: 9845 - DNA, 23 bp, Artificial Sequence
  Synthetic
ccgttttttttttttaaagatca

SEQ ID NO: 9846 - DNA, 23 bp, Artificial Sequence
  Synthetic
ccgttttttttttttgcgaatat

SEQ ID NO: 9847 - DNA, 23 bp, Artificial Sequence
  Synthetic
ccgttttttttttttccaggttc

SEQ ID NO: 9848 - DNA, 23 bp, Artificial Sequence
  Synthetic
ccgttttttttttttacactcaa

SEQ ID NO: 9849 - DNA, 23 bp, Artificial Sequence
  Synthetic
ccgttttttttttttacgctcaa

SEQ ID NO: 9850 - DNA, 23 bp, Artificial Sequence
  Synthetic
ccgttttttttttttacacccca

SEQ ID NO: 9851 - DNA, 23 bp, Artificial Sequence
  Synthetic
ccgttttttttttttggaaagcg

SEQ ID NO: 9852 - DNA, 23 bp, Artificial Sequence
  Synthetic
ccgttttttttttttcacttatc

SEQ ID NO: 9853 - DNA, 23 bp, Artificial Sequence
  Synthetic
ccgttttttttttttcacgcgag

SEQ ID NO: 9854 - DNA, 23 bp, Artificial Sequence
  Synthetic
ccgttttttttttttacgtggat

SEQ ID NO: 9855 - DNA, 23 bp, Artificial Sequence
  Synthetic
ccgttttttttttttctcataga

SEQ ID NO: 9856 - DNA, 23 bp, Artificial Sequence
  Synthetic
ccgttttttttttttaacatgga

SEQ ID NO: 9857 - DNA, 23 bp, Artificial Sequence
  Synthetic
ccgttttttttttttacaaaagt

SEQ ID NO: 9858 - DNA, 23 bp, Artificial Sequence
  Synthetic
ccgttttttttttttacacagga

SEQ ID NO: 9859 - DNA, 23 bp, Artificial Sequence
  Synthetic
ccgttttttttttttacgttcca

SEQ ID NO: 9860 - DNA, 23 bp, Artificial Sequence
  Synthetic
ccgttttttttttttaagatgtg

SEQ ID NO: 9861 - DNA, 23 bp, Artificial Sequence
  Synthetic
ccgttttttttttttgcgcatgt

SEQ ID NO: 9862 - DNA, 23 bp, Artificial Sequence
  Synthetic
ccgttttttttttttacagagag

SEQ ID NO: 9863 - DNA, 23 bp, Artificial Sequence
  Synthetic
ccgttttttttttttcgaatcca

SEQ ID NO: 9864 - DNA, 23 bp, Artificial Sequence
  Synthetic
ccgttttttttttttagccacaa

SEQ ID NO: 9865 - DNA, 23 bp, Artificial Sequence
  Synthetic
ccgttttttttttttatgaacaa

SEQ ID NO: 9866 - DNA, 23 bp, Artificial Sequence
  Synthetic
ccgttttttttttttaggggttc

SEQ ID NO: 9867 - DNA, 23 bp, Artificial Sequence
  Synthetic
ccgttttttttttttgcaaagtt

SEQ ID NO: 9868 - DNA, 23 bp, Artificial Sequence
  Synthetic
ccgttttttttttttacaggcca

SEQ ID NO: 9869 - DNA, 23 bp, Artificial Sequence
  Synthetic
ccgttttttttttttcgtacgct

SEQ ID NO: 9870 - DNA, 23 bp, Artificial Sequence
  Synthetic
ccgttttttttttttacggctag

SEQ ID NO: 9871 - DNA, 23 bp, Artificial Sequence
  Synthetic
ccgttttttttttttgcgcccaa

SEQ ID NO: 9872 - DNA, 23 bp, Artificial Sequence
  Synthetic
ccgttttttttttttggccttct

SEQ ID NO: 9873 - DNA, 23 bp, Artificial Sequence
  Synthetic
ccgttttttttttttggccttct

SEQ ID NO: 9874 - DNA, 23 bp, Artificial Sequence
  Synthetic
ccgttttttttttttctgagggg

SEQ ID NO: 9875 - DNA, 23 bp, Artificial Sequence
  Synthetic
ccgttttttttttttcaaaacat

SEQ ID NO: 9876 - DNA, 23 bp, Artificial Sequence
  Synthetic
ccgttttttttttttggcggaca

SEQ ID NO: 9877 - DNA, 23 bp, Artificial Sequence
  Synthetic
ccgttttttttttttcaacggga

SEQ ID NO: 9878 - DNA, 23 bp, Artificial Sequence
  Synthetic
ccgttttttttttttacggtttt

SEQ ID NO: 9879 - DNA, 23 bp, Artificial Sequence
  Synthetic
ccgttttttttttttgcatgacg

SEQ ID NO: 9880 - DNA, 23 bp, Artificial Sequence
  Synthetic
ccgttttttttttttccacccaa

SEQ ID NO: 9881 - DNA, 23 bp, Artificial Sequence
  Synthetic
ccgttttttttttttagacatgg

SEQ ID NO: 9882 - DNA, 23 bp, Artificial Sequence
  Synthetic
ccgttttttttttttacaccgag

SEQ ID NO: 9883 - DNA, 23 bp, Artificial Sequence
  Synthetic
ccgttttttttttttatgggaca

SEQ ID NO: 9884 - DNA, 23 bp, Artificial Sequence
  Synthetic
ccgttttttttttttaccagcta

SEQ ID NO: 9885 - DNA, 23 bp, Artificial Sequence
  Synthetic
ccgttttttttttttgccagcta

SEQ ID NO: 9886 - DNA, 23 bp, Artificial Sequence
  Synthetic
ccgttttttttttttattaggaa

SEQ ID NO: 9887 - DNA, 23 bp, Artificial Sequence
  Synthetic
ccgttttttttttttaaactcag

SEQ ID NO: 9888 - DNA, 23 bp, Artificial Sequence
  Synthetic
ccgttttttttttttgtctcagt

SEQ ID NO: 9889 - DNA, 23 bp, Artificial Sequence
  Synthetic
ccgttttttttttttcttctttg

SEQ ID NO: 9890 - DNA, 23 bp, Artificial Sequence
  Synthetic
ccgttttttttttttcgaactca

SEQ ID NO: 9891 - DNA, 23 bp, Artificial Sequence
  Synthetic
ccgttttttttttttaaacccta

SEQ ID NO: 9892 - DNA, 23 bp, Artificial Sequence
  Synthetic
ccgttttttttttttgcagagac

SEQ ID NO: 9893 - DNA, 23 bp, Artificial Sequence
  Synthetic
ccgttttttttttttcgatgtag

SEQ ID NO: 9894 - DNA, 23 bp, Artificial Sequence
  Synthetic
ccgttttttttttttagaagacg

SEQ ID NO: 9895 - DNA, 23 bp, Artificial Sequence
  Synthetic
ccgttttttttttttatcgggag

SEQ ID NO: 9896 - DNA, 23 bp, Artificial Sequence
  Synthetic
ccgttttttttttttagagagga

SEQ ID NO: 9897 - DNA, 23 bp, Artificial Sequence
  Synthetic
ccgttttttttttttgaattcat

SEQ ID NO: 9898 - DNA, 23 bp, Artificial Sequence
  Synthetic
ccgttttttttttttctcggggc

SEQ ID NO: 9899 - DNA, 23 bp, Artificial Sequence
  Synthetic
ccgttttttttttttaactggat

SEQ ID NO: 9900 - DNA, 23 bp, Artificial Sequence
  Synthetic
ccgttttttttttttaagtggat

SEQ ID NO: 9901 - DNA, 23 bp, Artificial Sequence
  Synthetic
ccgttttttttttttgagagtgc

SEQ ID NO: 9902 - DNA, 23 bp, Artificial Sequence
  Synthetic
ccgttttttttttttgctgccgt

SEQ ID NO: 9903 - DNA, 23 bp, Artificial Sequence
  Synthetic
ccgttttttttttttcagcatgg

SEQ ID NO: 9904 - DNA, 23 bp, Artificial Sequence
  Synthetic
ccgttttttttttttcctcatgg

SEQ ID NO: 9905 - DNA, 23 bp, Artificial Sequence
  Synthetic
ccgttttttttttttaagaatct

SEQ ID NO: 9906 - DNA, 23 bp, Artificial Sequence
  Synthetic
ccgttttttttttttctggcaca

SEQ ID NO: 9907 - DNA, 23 bp, Artificial Sequence
  Synthetic
ccgttttttttttttaatgaaag

SEQ ID NO: 9908 - DNA, 23 bp, Artificial Sequence
  Synthetic
ccgttttttttttttaagaggtt

SEQ ID NO: 9909 - DNA, 23 bp, Artificial Sequence
  Synthetic
ccgttttttttttttaaagaagt

SEQ ID NO: 9910 - DNA, 23 bp, Artificial Sequence
  Synthetic
ccgttttttttttttgagattgg

SEQ ID NO: 9911 - DNA, 23 bp, Artificial Sequence
  Synthetic
ccgttttttttttttacaaacca

SEQ ID NO: 9912 - DNA, 23 bp, Artificial Sequence
  Synthetic
ccgttttttttttttgaaaaacg

SEQ ID NO: 9913 - DNA, 23 bp, Artificial Sequence
  Synthetic
ccgttttttttttttaaacatca

SEQ ID NO: 9914 - DNA, 23 bp, Artificial Sequence
  Synthetic
ccgttttttttttttcagaatcc

SEQ ID NO: 9915 - DNA, 23 bp, Artificial Sequence
  Synthetic
ccgttttttttttttctcaccca

SEQ ID NO: 9916 - DNA, 23 bp, Artificial Sequence
  Synthetic
ccgttttttttttttagcaccca

SEQ ID NO: 9917 - DNA, 23 bp, Artificial Sequence
  Synthetic
ccgttttttttttttctgcagaa

SEQ ID NO: 9918 - DNA, 23 bp, Artificial Sequence
  Synthetic
ccgttttttttttttatagagtg

SEQ ID NO: 9919 - DNA, 23 bp, Artificial Sequence
  Synthetic
ccgttttttttttttgaggaaac

SEQ ID NO: 9920 - DNA, 23 bp, Artificial Sequence
  Synthetic
ccgttttttttttttctactcag

SEQ ID NO: 9921 - DNA, 23 bp, Artificial Sequence
  Synthetic
ccgttttttttttttcactccaa

SEQ ID NO: 9922 - DNA, 23 bp, Artificial Sequence
  Synthetic
ccgttttttttttttctactcca

SEQ ID NO: 9923 - DNA, 23 bp, Artificial Sequence
  Synthetic
ccgttttttttttttctacccac

SEQ ID NO: 9924 - DNA, 23 bp, Artificial Sequence
  Synthetic
ccgttttttttttttgtgattgc

SEQ ID NO: 9925 - DNA, 23 bp, Artificial Sequence
  Synthetic
ccgttttttttttttgactgcag

SEQ ID NO: 9926 - DNA, 23 bp, Artificial Sequence
  Synthetic
ccgttttttttttttgacctcag

SEQ ID NO: 9927 - DNA, 23 bp, Artificial Sequence
  Synthetic
ccgttttttttttttgaaagtgc

SEQ ID NO: 9928 - DNA, 23 bp, Artificial Sequence
  Synthetic
ccgttttttttttttataaatga

SEQ ID NO: 9929 - DNA, 23 bp, Artificial Sequence
  Synthetic
ccgttttttttttttctactcac

SEQ ID NO: 9930 - DNA, 23 bp, Artificial Sequence
  Synthetic
ccgttttttttttttacgctcca

SEQ ID NO: 9931 - DNA, 23 bp, Artificial Sequence
  Synthetic
ccgttttttttttttcagaaagt

SEQ ID NO: 9932 - DNA, 23 bp, Artificial Sequence
  Synthetic
ccgttttttttttttaccctctg

SEQ ID NO: 9933 - DNA, 23 bp, Artificial Sequence
  Synthetic
ccgttttttttttttaaagtgct

SEQ ID NO: 9934 - DNA, 23 bp, Artificial Sequence
  Synthetic
ccgttttttttttttagacagtg

SEQ ID NO: 9935 - DNA, 23 bp, Artificial Sequence
  Synthetic
ccgttttttttttttaacactct

SEQ ID NO: 9936 - DNA, 23 bp, Artificial Sequence
  Synthetic
ccgttttttttttttaacactct

SEQ ID NO: 9937 - DNA, 23 bp, Artificial Sequence
  Synthetic
ccgttttttttttttacactcta

SEQ ID NO: 9938 - DNA, 23 bp, Artificial Sequence
  Synthetic
ccgttttttttttttccagcaaa

SEQ ID NO: 9939 - DNA, 23 bp, Artificial Sequence
  Synthetic
ccgttttttttttttacctctaa

SEQ ID NO: 9940 - DNA, 23 bp, Artificial Sequence
  Synthetic
ccgttttttttttttcactctaa

SEQ ID NO: 9941 - DNA, 23 bp, Artificial Sequence
  Synthetic
ccgttttttttttttcagaaagt

SEQ ID NO: 9942 - DNA, 23 bp, Artificial Sequence
  Synthetic
ccgttttttttttttgctccaaa

SEQ ID NO: 9943 - DNA, 23 bp, Artificial Sequence
  Synthetic
ccgttttttttttttacactctg

SEQ ID NO: 9944 - DNA, 23 bp, Artificial Sequence
  Synthetic
ccgttttttttttttcctctaaa

SEQ ID NO: 9945 - DNA, 23 bp, Artificial Sequence
  Synthetic
ccgttttttttttttagagaaag

SEQ ID NO: 9946 - DNA, 23 bp, Artificial Sequence
  Synthetic
ccgttttttttttttgtaacact

SEQ ID NO: 9947 - DNA, 23 bp, Artificial Sequence
  Synthetic
ccgttttttttttttaaacctct

SEQ ID NO: 9948 - DNA, 23 bp, Artificial Sequence
  Synthetic
ccgttttttttttttatcctcta

SEQ ID NO: 9949 - DNA, 23 bp, Artificial Sequence
  Synthetic
ccgttttttttttttacactcta

SEQ ID NO: 9950 - DNA, 23 bp, Artificial Sequence
  Synthetic
ccgttttttttttttacactcta

SEQ ID NO: 9951 - DNA, 23 bp, Artificial Sequence
  Synthetic
ccgttttttttttttgaaagtgc

SEQ ID NO: 9952 - DNA, 23 bp, Artificial Sequence
  Synthetic
ccgttttttttttttacagtcca

SEQ ID NO: 9953 - DNA, 23 bp, Artificial Sequence
  Synthetic
ccgttttttttttttagaaagta

SEQ ID NO: 9954 - DNA, 23 bp, Artificial Sequence
  Synthetic
ccgttttttttttttccctctaa

SEQ ID NO: 9955 - DNA, 23 bp, Artificial Sequence
  Synthetic
ccgttttttttttttaaccctct

SEQ ID NO: 9956 - DNA, 23 bp, Artificial Sequence
  Synthetic
ccgttttttttttttaacccacc

SEQ ID NO: 9957 - DNA, 23 bp, Artificial Sequence
  Synthetic
ccgttttttttttttcagaaagg

SEQ ID NO: 9958 - DNA, 23 bp, Artificial Sequence
  Synthetic
ccgttttttttttttccctcaaa

SEQ ID NO: 9959 - DNA, 23 bp, Artificial Sequence
  Synthetic
ccgttttttttttttaaccctct

SEQ ID NO: 9960 - DNA, 23 bp, Artificial Sequence
  Synthetic
ccgttttttttttttacactcta

SEQ ID NO: 9961 - DNA, 23 bp, Artificial Sequence
  Synthetic
ccgttttttttttttactctaaa

SEQ ID NO: 9962 - DNA, 23 bp, Artificial Sequence
  Synthetic
ccgttttttttttttacactcta

SEQ ID NO: 9963 - DNA, 23 bp, Artificial Sequence
  Synthetic
ccgttttttttttttaacactct

SEQ ID NO: 9964 - DNA, 23 bp, Artificial Sequence
  Synthetic
ccgttttttttttttccctctat

SEQ ID NO: 9965 - DNA, 23 bp, Artificial Sequence
  Synthetic
ccgttttttttttttactccaaa

SEQ ID NO: 9966 - DNA, 23 bp, Artificial Sequence
  Synthetic
ccgttttttttttttgagaaagt

SEQ ID NO: 9967 - DNA, 23 bp, Artificial Sequence
  Synthetic
ccgttttttttttttagaaagtg

SEQ ID NO: 9968 - DNA, 23 bp, Artificial Sequence
  Synthetic
ccgttttttttttttgctctaaa

SEQ ID NO: 9969 - DNA, 23 bp, Artificial Sequence
  Synthetic
ccgttttttttttttagaaagtg

SEQ ID NO: 9970 - DNA, 23 bp, Artificial Sequence
  Synthetic
ccgttttttttttttaacagaaa

SEQ ID NO: 9971 - DNA, 23 bp, Artificial Sequence
  Synthetic
ccgttttttttttttgcctctaa

SEQ ID NO: 9972 - DNA, 23 bp, Artificial Sequence
  Synthetic
ccgttttttttttttaacagaaa

SEQ ID NO: 9973 - DNA, 23 bp, Artificial Sequence
  Synthetic
ccgttttttttttttagaaaggg

SEQ ID NO: 9974 - DNA, 23 bp, Artificial Sequence
  Synthetic
ccgttttttttttttacggtcct

SEQ ID NO: 9975 - DNA, 23 bp, Artificial Sequence
  Synthetic
ccgttttttttttttacacacca

SEQ ID NO: 9976 - DNA, 23 bp, Artificial Sequence
  Synthetic
ccgttttttttttttcagttatc

SEQ ID NO: 9977 - DNA, 23 bp, Artificial Sequence
  Synthetic
ccgttttttttttttctcgtgac

SEQ ID NO: 9978 - DNA, 23 bp, Artificial Sequence
  Synthetic
ccgttttttttttttacttgcta

SEQ ID NO: 9979 - DNA, 23 bp, Artificial Sequence
  Synthetic
ccgttttttttttttcacacaat

SEQ ID NO: 9980 - DNA, 23 bp, Artificial Sequence
  Synthetic
ccgttttttttttttgcaaaagt

SEQ ID NO: 9981 - DNA, 23 bp, Artificial Sequence
  Synthetic
ccgttttttttttttacaaaagc

SEQ ID NO: 9982 - DNA, 23 bp, Artificial Sequence
  Synthetic
ccgttttttttttttgcaaaagt

SEQ ID NO: 9983 - DNA, 23 bp, Artificial Sequence
  Synthetic
ccgttttttttttttgcaaaaga

SEQ ID NO: 9984 - DNA, 23 bp, Artificial Sequence
  Synthetic
ccgttttttttttttagagctca

SEQ ID NO: 9985 - DNA, 23 bp, Artificial Sequence
  Synthetic
ccgttttttttttttatgtgcct

SEQ ID NO: 9986 - DNA, 23 bp, Artificial Sequence
  Synthetic
ccgttttttttttttggaaacca

SEQ ID NO: 9987 - DNA, 23 bp, Artificial Sequence
  Synthetic
ccgttttttttttttctgaaacc

SEQ ID NO: 9988 - DNA, 23 bp, Artificial Sequence
  Synthetic
ccgttttttttttttgtctaacc

SEQ ID NO: 9989 - DNA, 23 bp, Artificial Sequence
  Synthetic
ccgttttttttttttaaaacaaa

SEQ ID NO: 9990 - DNA, 23 bp, Artificial Sequence
  Synthetic
ccgttttttttttttactggctg

SEQ ID NO: 9991 - DNA, 23 bp, Artificial Sequence
  Synthetic
ccgttttttttttttatcagagg

SEQ ID NO: 9992 - DNA, 23 bp, Artificial Sequence
  Synthetic
ccgttttttttttttcatattac

SEQ ID NO: 9993 - DNA, 23 bp, Artificial Sequence
  Synthetic
ccgttttttttttttagacaagg

SEQ ID NO: 9994 - DNA, 23 bp, Artificial Sequence
  Synthetic
ccgttttttttttttattttggt

SEQ ID NO: 9995 - DNA, 23 bp, Artificial Sequence
  Synthetic
ccgttttttttttttggtgcata

SEQ ID NO: 9996 - DNA, 23 bp, Artificial Sequence
  Synthetic
ccgttttttttttttggcggccg

SEQ ID NO: 9997 - DNA, 23 bp, Artificial Sequence
  Synthetic
ccgttttttttttttacttcaag

SEQ ID NO: 9998 - DNA, 23 bp, Artificial Sequence
  Synthetic
ccgttttttttttttgcaaatgg

SEQ ID NO: 9999 - DNA, 23 bp, Artificial Sequence
  Synthetic
ccgttttttttttttgggaaacg

SEQ ID NO: 10000 - DNA, 23 bp, Artificial Sequence
  Synthetic
ccgttttttttttttgcctgctg

SEQ ID NO: 10001 - DNA, 23 bp, Artificial Sequence
  Synthetic
ccgttttttttttttaaacagac

SEQ ID NO: 10002 - DNA, 23 bp, Artificial Sequence
  Synthetic
ccgttttttttttttgttgggat

SEQ ID NO: 10003 - DNA, 23 bp, Artificial Sequence
  Synthetic
ccgttttttttttttgttctgtc

SEQ ID NO: 10004 - DNA, 23 bp, Artificial Sequence
  Synthetic
ccgttttttttttttgtgtgtat

SEQ ID NO: 10005 - DNA, 23 bp, Artificial Sequence
  Synthetic
ccgttttttttttttactttcca

SEQ ID NO: 10006 - DNA, 23 bp, Artificial Sequence
  Synthetic
ccgttttttttttttgcaaaggt

SEQ ID NO: 10007 - DNA, 23 bp, Artificial Sequence
  Synthetic
ccgttttttttttttctcactca

SEQ ID NO: 10008 - DNA, 23 bp, Artificial Sequence
  Synthetic
ccgttttttttttttgggccacc

SEQ ID NO: 10009 - DNA, 23 bp, Artificial Sequence
  Synthetic
ccgttttttttttttctgatcag

SEQ ID NO: 10010 - DNA, 23 bp, Artificial Sequence
  Synthetic
ccgttttttttttttgtgggtgt

SEQ ID NO: 10011 - DNA, 23 bp, Artificial Sequence
  Synthetic
ccgttttttttttttgctcctgt

SEQ ID NO: 10012 - DNA, 23 bp, Artificial Sequence
  Synthetic
ccgttttttttttttcaaagacg

SEQ ID NO: 10013 - DNA, 23 bp, Artificial Sequence
  Synthetic
ccgttttttttttttcaggtacc

SEQ ID NO: 10014 - DNA, 23 bp, Artificial Sequence
  Synthetic
ccgttttttttttttacaatcct

SEQ ID NO: 10015 - DNA, 23 bp, Artificial Sequence
  Synthetic
ccgttttttttttttatcgcggt

SEQ ID NO: 10016 - DNA, 23 bp, Artificial Sequence
  Synthetic
ccgttttttttttttcctaatga

SEQ ID NO: 10017 - DNA, 23 bp, Artificial Sequence
  Synthetic
ccgttttttttttttactgatct

SEQ ID NO: 10018 - DNA, 23 bp, Artificial Sequence
  Synthetic
ccgttttttttttttagtaactg

SEQ ID NO: 10019 - DNA, 23 bp, Artificial Sequence
  Synthetic
ccgttttttttttttgtaatggg

SEQ ID NO: 10020 - DNA, 23 bp, Artificial Sequence
  Synthetic
ccgttttttttttttctcagtcc

SEQ ID NO: 10021 - DNA, 23 bp, Artificial Sequence
  Synthetic
ccgttttttttttttagcataca

SEQ ID NO: 10022 - DNA, 23 bp, Artificial Sequence
  Synthetic
ccgttttttttttttggacctaa

SEQ ID NO: 10023 - DNA, 23 bp, Artificial Sequence
  Synthetic
ccgttttttttttttgtgactca

SEQ ID NO: 10024 - DNA, 23 bp, Artificial Sequence
  Synthetic
ccgttttttttttttgttctaac

SEQ ID NO: 10025 - DNA, 23 bp, Artificial Sequence
  Synthetic
ccgttttttttttttctgggaac

SEQ ID NO: 10026 - DNA, 23 bp, Artificial Sequence
  Synthetic
ccgttttttttttttctgcactt

SEQ ID NO: 10027 - DNA, 23 bp, Artificial Sequence
  Synthetic
ccgttttttttttttacaatgag

SEQ ID NO: 10028 - DNA, 23 bp, Artificial Sequence
  Synthetic
ccgttttttttttttacatcatc

SEQ ID NO: 10029 - DNA, 23 bp, Artificial Sequence
  Synthetic
ccgttttttttttttgctgagca

SEQ ID NO: 10030 - DNA, 23 bp, Artificial Sequence
  Synthetic
ccgttttttttttttaaagtcac

SEQ ID NO: 10031 - DNA, 23 bp, Artificial Sequence
  Synthetic
ccgttttttttttttagacacac

SEQ ID NO: 10032 - DNA, 23 bp, Artificial Sequence
  Synthetic
ccgttttttttttttcccgagga

SEQ ID NO: 10033 - DNA, 23 bp, Artificial Sequence
  Synthetic
ccgttttttttttttacagtggt

SEQ ID NO: 10034 - DNA, 23 bp, Artificial Sequence
  Synthetic
ccgttttttttttttgacgatga

SEQ ID NO: 10035 - DNA, 23 bp, Artificial Sequence
  Synthetic
ccgttttttttttttgtttgata

SEQ ID NO: 10036 - DNA, 23 bp, Artificial Sequence
  Synthetic
ccgttttttttttttgagcaagg

SEQ ID NO: 10037 - DNA, 23 bp, Artificial Sequence
  Synthetic
ccgttttttttttttctcctcca

SEQ ID NO: 10038 - DNA, 23 bp, Artificial Sequence
  Synthetic
ccgttttttttttttgggccgca

SEQ ID NO: 10039 - DNA, 23 bp, Artificial Sequence
  Synthetic
ccgttttttttttttgcaaaagt

SEQ ID NO: 10040 - DNA, 23 bp, Artificial Sequence
  Synthetic
ccgttttttttttttgtcctgaa

SEQ ID NO: 10041 - DNA, 23 bp, Artificial Sequence
  Synthetic
ccgttttttttttttaggagaag

SEQ ID NO: 10042 - DNA, 23 bp, Artificial Sequence
  Synthetic
ccgttttttttttttatctttga

SEQ ID NO: 10043 - DNA, 23 bp, Artificial Sequence
  Synthetic
ccgttttttttttttgttataga

SEQ ID NO: 10044 - DNA, 23 bp, Artificial Sequence
  Synthetic
ccgttttttttttttacggagct

SEQ ID NO: 10045 - DNA, 23 bp, Artificial Sequence
  Synthetic
ccgttttttttttttagagatga

SEQ ID NO: 10046 - DNA, 23 bp, Artificial Sequence
  Synthetic
ccgttttttttttttcccagcac

SEQ ID NO: 10047 - DNA, 23 bp, Artificial Sequence
  Synthetic
ccgttttttttttttgtcagacc

SEQ ID NO: 10048 - DNA, 23 bp, Artificial Sequence
  Synthetic
ccgttttttttttttaaggagct

SEQ ID NO: 10049 - DNA, 23 bp, Artificial Sequence
  Synthetic
ccgttttttttttttggcaaaga

SEQ ID NO: 10050 - DNA, 23 bp, Artificial Sequence
  Synthetic
ccgttttttttttttccacctgg

SEQ ID NO: 10051 - DNA, 23 bp, Artificial Sequence
  Synthetic
ccgttttttttttttagagggag

SEQ ID NO: 10052 - DNA, 23 bp, Artificial Sequence
  Synthetic
ccgttttttttttttaagtcact

SEQ ID NO: 10053 - DNA, 23 bp, Artificial Sequence
  Synthetic
ccgttttttttttttgccacctt

SEQ ID NO: 10054 - DNA, 23 bp, Artificial Sequence
  Synthetic
ccgttttttttttttactcagaa

SEQ ID NO: 10055 - DNA, 23 bp, Artificial Sequence
  Synthetic
ccgttttttttttttactgggca

SEQ ID NO: 10056 - DNA, 23 bp, Artificial Sequence
  Synthetic
ccgttttttttttttatttctat

SEQ ID NO: 10057 - DNA, 23 bp, Artificial Sequence
  Synthetic
ccgttttttttttttaggtaagc

SEQ ID NO: 10058 - DNA, 23 bp, Artificial Sequence
  Synthetic
ccgttttttttttttgctccaac

SEQ ID NO: 10059 - DNA, 23 bp, Artificial Sequence
  Synthetic
ccgttttttttttttacccaaca

SEQ ID NO: 10060 - DNA, 23 bp, Artificial Sequence
  Synthetic
ccgttttttttttttgaacacaa

SEQ ID NO: 10061 - DNA, 23 bp, Artificial Sequence
  Synthetic
ccgttttttttttttaggactat

SEQ ID NO: 10062 - DNA, 23 bp, Artificial Sequence
  Synthetic
ccgttttttttttttaagacatt

SEQ ID NO: 10063 - DNA, 23 bp, Artificial Sequence
  Synthetic
ccgttttttttttttcctctttt

SEQ ID NO: 10064 - DNA, 23 bp, Artificial Sequence
  Synthetic
ccgttttttttttttcgactgcc

SEQ ID NO: 10065 - DNA, 23 bp, Artificial Sequence
  Synthetic
ccgttttttttttttgctgggct

SEQ ID NO: 10066 - DNA, 23 bp, Artificial Sequence
  Synthetic
ccgttttttttttttaccttccc

SEQ ID NO: 10067 - DNA, 23 bp, Artificial Sequence
  Synthetic
ccgttttttttttttgctgaggt

SEQ ID NO: 10068 - DNA, 23 bp, Artificial Sequence
  Synthetic
ccgttttttttttttcccacagg

SEQ ID NO: 10069 - DNA, 23 bp, Artificial Sequence
  Synthetic
ccgttttttttttttattgtggt

SEQ ID NO: 10070 - DNA, 23 bp, Artificial Sequence
  Synthetic
ccgttttttttttttgtccaaag

SEQ ID NO: 10071 - DNA, 23 bp, Artificial Sequence
  Synthetic
ccgttttttttttttggacattg

SEQ ID NO: 10072 - DNA, 23 bp, Artificial Sequence
  Synthetic
ccgttttttttttttctgcgggc

SEQ ID NO: 10073 - DNA, 23 bp, Artificial Sequence
  Synthetic
ccgttttttttttttacgcagag

SEQ ID NO: 10074 - DNA, 23 bp, Artificial Sequence
  Synthetic
ccgttttttttttttaggccgcc

SEQ ID NO: 10075 - DNA, 23 bp, Artificial Sequence
  Synthetic
ccgttttttttttttacagcgct

SEQ ID NO: 10076 - DNA, 23 bp, Artificial Sequence
  Synthetic
ccgttttttttttttagaggcag

SEQ ID NO: 10077 - DNA, 23 bp, Artificial Sequence
  Synthetic
ccgttttttttttttgaggtgac

SEQ ID NO: 10078 - DNA, 23 bp, Artificial Sequence
  Synthetic
ccgttttttttttttcaagacac

SEQ ID NO: 10079 - DNA, 23 bp, Artificial Sequence
  Synthetic
ccgttttttttttttctacctga

SEQ ID NO: 10080 - DNA, 23 bp, Artificial Sequence
  Synthetic
ccgttttttttttttgctctaag

SEQ ID NO: 10081 - DNA, 23 bp, Artificial Sequence
  Synthetic
ccgttttttttttttcagcagta

SEQ ID NO: 10082 - DNA, 23 bp, Artificial Sequence
  Synthetic
ccgttttttttttttgcctcaga

SEQ ID NO: 10083 - DNA, 23 bp, Artificial Sequence
  Synthetic
ccgttttttttttttgaaggaag

SEQ ID NO: 10084 - DNA, 23 bp, Artificial Sequence
  Synthetic
ccgttttttttttttaccagtgc

SEQ ID NO: 10085 - DNA, 23 bp, Artificial Sequence
  Synthetic
ccgttttttttttttgactcttg

SEQ ID NO: 10086 - DNA, 23 bp, Artificial Sequence
  Synthetic
ccgttttttttttttgtcctgag

SEQ ID NO: 10087 - DNA, 23 bp, Artificial Sequence
  Synthetic
ccgttttttttttttcaaaagtc

SEQ ID NO: 10088 - DNA, 23 bp, Artificial Sequence
  Synthetic
ccgttttttttttttgcacaacc

SEQ ID NO: 10089 - DNA, 23 bp, Artificial Sequence
  Synthetic
ccgttttttttttttgttcagta

SEQ ID NO: 10090 - DNA, 23 bp, Artificial Sequence
  Synthetic
ccgttttttttttttgcacatgt

SEQ ID NO: 10091 - DNA, 23 bp, Artificial Sequence
  Synthetic
ccgttttttttttttaaagaggt

SEQ ID NO: 10092 - DNA, 23 bp, Artificial Sequence
  Synthetic
ccgttttttttttttagaggttg

SEQ ID NO: 10093 - DNA, 23 bp, Artificial Sequence
  Synthetic
ccgttttttttttttcctagaga

SEQ ID NO: 10094 - DNA, 23 bp, Artificial Sequence
  Synthetic
ccgttttttttttttaccaacgg

SEQ ID NO: 10095 - DNA, 23 bp, Artificial Sequence
  Synthetic
ccgttttttttttttggggaccc

SEQ ID NO: 10096 - DNA, 23 bp, Artificial Sequence
  Synthetic
ccgttttttttttttcaactccg

SEQ ID NO: 10097 - DNA, 23 bp, Artificial Sequence
  Synthetic
ccgttttttttttttacgcgcag

SEQ ID NO: 10098 - DNA, 23 bp, Artificial Sequence
  Synthetic
ccgttttttttttttctgctggg

SEQ ID NO: 10099 - DNA, 23 bp, Artificial Sequence
  Synthetic
ccgttttttttttttgcggtccc

SEQ ID NO: 10100 - DNA, 23 bp, Artificial Sequence
  Synthetic
ccgttttttttttttgtagtggg

SEQ ID NO: 10101 - DNA, 23 bp, Artificial Sequence
  Synthetic
ccgttttttttttttacctccag

SEQ ID NO: 10102 - DNA, 23 bp, Artificial Sequence
  Synthetic
ccgttttttttttttcaacaaaa

SEQ ID NO: 10103 - DNA, 23 bp, Artificial Sequence
  Synthetic
ccgttttttttttttggttagtg

SEQ ID NO: 10104 - DNA, 23 bp, Artificial Sequence
  Synthetic
ccgttttttttttttcatcacct

SEQ ID NO: 10105 - DNA, 23 bp, Artificial Sequence
  Synthetic
ccgttttttttttttgctgaggc

SEQ ID NO: 10106 - DNA, 23 bp, Artificial Sequence
  Synthetic
ccgttttttttttttagaaacca

SEQ ID NO: 10107 - DNA, 23 bp, Artificial Sequence
  Synthetic
ccgttttttttttttcatgctca

SEQ ID NO: 10108 - DNA, 23 bp, Artificial Sequence
  Synthetic
ccgttttttttttttgtcagcag

SEQ ID NO: 10109 - DNA, 23 bp, Artificial Sequence
  Synthetic
ccgttttttttttttatcactcc

SEQ ID NO: 10110 - DNA, 23 bp, Artificial Sequence
  Synthetic
ccgttttttttttttaaccaaga

SEQ ID NO: 10111 - DNA, 23 bp, Artificial Sequence
  Synthetic
ccgttttttttttttagctcaga

SEQ ID NO: 10112 - DNA, 23 bp, Artificial Sequence
  Synthetic
ccgttttttttttttggccctga

SEQ ID NO: 10113 - DNA, 23 bp, Artificial Sequence
  Synthetic
ccgttttttttttttgtcgattc

SEQ ID NO: 10114 - DNA, 23 bp, Artificial Sequence
  Synthetic
ccgttttttttttttacaaggat

SEQ ID NO: 10115 - DNA, 23 bp, Artificial Sequence
  Synthetic
ccgttttttttttttcatacagc

SEQ ID NO: 10116 - DNA, 23 bp, Artificial Sequence
  Synthetic
ccgttttttttttttactttcgg

SEQ ID NO: 10117 - DNA, 23 bp, Artificial Sequence
  Synthetic
ccgttttttttttttcaggccgg

SEQ ID NO: 10118 - DNA, 23 bp, Artificial Sequence
  Synthetic
ccgttttttttttttgaggccgg

SEQ ID NO: 10119 - DNA, 23 bp, Artificial Sequence
  Synthetic
ccgttttttttttttctacctgc

SEQ ID NO: 10120 - DNA, 23 bp, Artificial Sequence
  Synthetic
ccgttttttttttttgctcaata

SEQ ID NO: 10121 - DNA, 23 bp, Artificial Sequence
  Synthetic
ccgttttttttttttgcaaaaat

SEQ ID NO: 10122 - DNA, 23 bp, Artificial Sequence
  Synthetic
ccgttttttttttttaacaatac

SEQ ID NO: 10123 - DNA, 23 bp, Artificial Sequence
  Synthetic
ccgttttttttttttcacaagat

SEQ ID NO: 10124 - DNA, 23 bp, Artificial Sequence
  Synthetic
ccgttttttttttttcgcaaggt

SEQ ID NO: 10125 - DNA, 23 bp, Artificial Sequence
  Synthetic
ccgttttttttttttcttccact

SEQ ID NO: 10126 - DNA, 23 bp, Artificial Sequence
  Synthetic
ccgttttttttttttgcttacac

SEQ ID NO: 10127 - DNA, 23 bp, Artificial Sequence
  Synthetic
ccgttttttttttttgccactcg

SEQ ID NO: 10128 - DNA, 23 bp, Artificial Sequence
  Synthetic
ccgttttttttttttgccactcg

SEQ ID NO: 10129 - DNA, 23 bp, Artificial Sequence
  Synthetic
ccgttttttttttttcggacaca

SEQ ID NO: 10130 - DNA, 23 bp, Artificial Sequence
  Synthetic
ccgttttttttttttcggagagg

SEQ ID NO: 10131 - DNA, 23 bp, Artificial Sequence
  Synthetic
ccgttttttttttttcagatcga

SEQ ID NO: 10132 - DNA, 23 bp, Artificial Sequence
  Synthetic
ccgttttttttttttcgctgccg

SEQ ID NO: 10133 - DNA, 23 bp, Artificial Sequence
  Synthetic
ccgttttttttttttgtcacatt

SEQ ID NO: 10134 - DNA, 23 bp, Artificial Sequence
  Synthetic
ccgttttttttttttcagctagg

SEQ ID NO: 10135 - DNA, 23 bp, Artificial Sequence
  Synthetic
ccgttttttttttttcctagagt

SEQ ID NO: 10136 - DNA, 23 bp, Artificial Sequence
  Synthetic
ccgttttttttttttccggcaag

SEQ ID NO: 10137 - DNA, 23 bp, Artificial Sequence
  Synthetic
ccgttttttttttttctcaacag

SEQ ID NO: 10138 - DNA, 23 bp, Artificial Sequence
  Synthetic
ccgttttttttttttccgatgga

SEQ ID NO: 10139 - DNA, 23 bp, Artificial Sequence
  Synthetic
ccgttttttttttttagcgccag

SEQ ID NO: 10140 - DNA, 23 bp, Artificial Sequence
  Synthetic
ccgttttttttttttcgtgctct

SEQ ID NO: 10141 - DNA, 23 bp, Artificial Sequence
  Synthetic
ccgttttttttttttacgcagct

SEQ ID NO: 10142 - DNA, 23 bp, Artificial Sequence
  Synthetic
ccgttttttttttttagcggggt

SEQ ID NO: 10143 - DNA, 23 bp, Artificial Sequence
  Synthetic
ccgttttttttttttcacaagtt

SEQ ID NO: 10144 - DNA, 23 bp, Artificial Sequence
  Synthetic
ccgttttttttttttcacaaacc

SEQ ID NO: 10145 - DNA, 23 bp, Artificial Sequence
  Synthetic
ccgttttttttttttcaccaata

SEQ ID NO: 10146 - DNA, 23 bp, Artificial Sequence
  Synthetic
ccgttttttttttttacaagtgc

SEQ ID NO: 10147 - DNA, 23 bp, Artificial Sequence
  Synthetic
ccgttttttttttttactacctg

SEQ ID NO: 10148 - DNA, 23 bp, Artificial Sequence
  Synthetic
ccgttttttttttttatctgcac

SEQ ID NO: 10149 - DNA, 23 bp, Artificial Sequence
  Synthetic
ccgttttttttttttcagttttg

SEQ ID NO: 10150 - DNA, 23 bp, Artificial Sequence
  Synthetic
ccgttttttttttttcagttttg

SEQ ID NO: 10151 - DNA, 23 bp, Artificial Sequence
  Synthetic
ccgttttttttttttacctgcac

SEQ ID NO: 10152 - DNA, 23 bp, Artificial Sequence
  Synthetic
ccgttttttttttttcacagttg

SEQ ID NO: 10153 - DNA, 23 bp, Artificial Sequence
  Synthetic
ccgttttttttttttacatggtt

SEQ ID NO: 10154 - DNA, 23 bp, Artificial Sequence
  Synthetic
ccgttttttttttttacagttct

SEQ ID NO: 10155 - DNA, 23 bp, Artificial Sequence
  Synthetic
ccgttttttttttttggaaatcc

SEQ ID NO: 10156 - DNA, 23 bp, Artificial Sequence
  Synthetic
ccgttttttttttttggcggaac

SEQ ID NO: 10157 - DNA, 23 bp, Artificial Sequence
  Synthetic
ccgttttttttttttacaggccg

SEQ ID NO: 10158 - DNA, 23 bp, Artificial Sequence
  Synthetic
ccgttttttttttttcacaagtt

SEQ ID NO: 10159 - DNA, 23 bp, Artificial Sequence
  Synthetic
ccgttttttttttttcttcagtt

SEQ ID NO: 10160 - DNA, 23 bp, Artificial Sequence
  Synthetic
ccgttttttttttttcatagccc

SEQ ID NO: 10161 - DNA, 23 bp, Artificial Sequence
  Synthetic
ccgttttttttttttacaggagt

SEQ ID NO: 10162 - DNA, 23 bp, Artificial Sequence
  Synthetic
ccgttttttttttttatctgcac

SEQ ID NO: 10163 - DNA, 23 bp, Artificial Sequence
  Synthetic
ccgttttttttttttgatagccc

SEQ ID NO: 10164 - DNA, 23 bp, Artificial Sequence
  Synthetic
ccgttttttttttttggcattca

SEQ ID NO: 10165 - DNA, 23 bp, Artificial Sequence
  Synthetic
ccgttttttttttttcacaagtt

SEQ ID NO: 10166 - DNA, 23 bp, Artificial Sequence
  Synthetic
ccgttttttttttttagccaagc

SEQ ID NO: 10167 - DNA, 23 bp, Artificial Sequence
  Synthetic
ccgttttttttttttacagctgg

SEQ ID NO: 10168 - DNA, 23 bp, Artificial Sequence
  Synthetic
ccgttttttttttttcacatagg

SEQ ID NO: 10169 - DNA, 23 bp, Artificial Sequence
  Synthetic
ccgttttttttttttagacacgt

SEQ ID NO: 10170 - DNA, 23 bp, Artificial Sequence
  Synthetic
ccgttttttttttttgagctaca

SEQ ID NO: 10171 - DNA, 23 bp, Artificial Sequence
  Synthetic
ccgttttttttttttcacaaacc

SEQ ID NO: 10172 - DNA, 23 bp, Artificial Sequence
  Synthetic
ccgttttttttttttgtaaacca

SEQ ID NO: 10173 - DNA, 23 bp, Artificial Sequence
  Synthetic
ccgttttttttttttcgccaata

SEQ ID NO: 10174 - DNA, 23 bp, Artificial Sequence
  Synthetic
ccgttttttttttttacaagtgc

SEQ ID NO: 10175 - DNA, 23 bp, Artificial Sequence
  Synthetic
ccgttttttttttttactacctg

SEQ ID NO: 10176 - DNA, 23 bp, Artificial Sequence
  Synthetic
ccgttttttttttttatctgcac

SEQ ID NO: 10177 - DNA, 23 bp, Artificial Sequence
  Synthetic
ccgttttttttttttactcaccg

SEQ ID NO: 10178 - DNA, 23 bp, Artificial Sequence
  Synthetic
ccgttttttttttttggtacaat

SEQ ID NO: 10179 - DNA, 23 bp, Artificial Sequence
  Synthetic
ccgttttttttttttaacccacc

SEQ ID NO: 10180 - DNA, 23 bp, Artificial Sequence
  Synthetic
ccgttttttttttttcccaacaa

SEQ ID NO: 10181 - DNA, 23 bp, Artificial Sequence
  Synthetic
ccgttttttttttttcctagctc

SEQ ID NO: 10182 - DNA, 23 bp, Artificial Sequence
  Synthetic
ccgttttttttttttgaacaggt

SEQ ID NO: 10183 - DNA, 23 bp, Artificial Sequence
  Synthetic
ccgttttttttttttcagttttg

SEQ ID NO: 10184 - DNA, 23 bp, Artificial Sequence
  Synthetic
ccgttttttttttttcagttttg

SEQ ID NO: 10185 - DNA, 23 bp, Artificial Sequence
  Synthetic
ccgttttttttttttacctgcac

SEQ ID NO: 10186 - DNA, 23 bp, Artificial Sequence
  Synthetic
ccgttttttttttttcagactcc

SEQ ID NO: 10187 - DNA, 23 bp, Artificial Sequence
  Synthetic
ccgttttttttttttacatggtt

SEQ ID NO: 10188 - DNA, 23 bp, Artificial Sequence
  Synthetic
ccgttttttttttttacagttct

SEQ ID NO: 10189 - DNA, 23 bp, Artificial Sequence
  Synthetic
ccgttttttttttttcagaccga

SEQ ID NO: 10190 - DNA, 23 bp, Artificial Sequence
  Synthetic
ccgttttttttttttagcctatc

SEQ ID NO: 10191 - DNA, 23 bp, Artificial Sequence
  Synthetic
ccgttttttttttttctcaatag

SEQ ID NO: 10192 - DNA, 23 bp, Artificial Sequence
  Synthetic
ccgttttttttttttaaccgatt

SEQ ID NO: 10193 - DNA, 23 bp, Artificial Sequence
  Synthetic
ccgttttttttttttactgattt

SEQ ID NO: 10194 - DNA, 23 bp, Artificial Sequence
  Synthetic
ccgttttttttttttgctgagtg

SEQ ID NO: 10195 - DNA, 23 bp, Artificial Sequence
  Synthetic
ccgttttttttttttgctgagag

SEQ ID NO: 10196 - DNA, 23 bp, Artificial Sequence
  Synthetic
ccgttttttttttttacaaccag

SEQ ID NO: 10197 - DNA, 23 bp, Artificial Sequence
  Synthetic
ccgttttttttttttaacaaaat

SEQ ID NO: 10198 - DNA, 23 bp, Artificial Sequence
  Synthetic
ccgttttttttttttcatacagc

SEQ ID NO: 10199 - DNA, 23 bp, Artificial Sequence
  Synthetic
ccgttttttttttttacaggccg

SEQ ID NO: 10200 - DNA, 23 bp, Artificial Sequence
  Synthetic
ccgttttttttttttctacctgc

SEQ ID NO: 10201 - DNA, 23 bp, Artificial Sequence
  Synthetic
ccgttttttttttttgctcaata

SEQ ID NO: 10202 - DNA, 23 bp, Artificial Sequence
  Synthetic
ccgttttttttttttcacaagat

SEQ ID NO: 10203 - DNA, 23 bp, Artificial Sequence
  Synthetic
ccgttttttttttttaactatac

SEQ ID NO: 10204 - DNA, 23 bp, Artificial Sequence
  Synthetic
ccgttttttttttttaaccacac

SEQ ID NO: 10205 - DNA, 23 bp, Artificial Sequence
  Synthetic
ccgttttttttttttactatgca

SEQ ID NO: 10206 - DNA, 23 bp, Artificial Sequence
  Synthetic
ccgttttttttttttaactatac

SEQ ID NO: 10207 - DNA, 23 bp, Artificial Sequence
  Synthetic
ccgttttttttttttactgtaca

SEQ ID NO: 10208 - DNA, 23 bp, Artificial Sequence
  Synthetic
ccgttttttttttttacagcaca

SEQ ID NO: 10209 - DNA, 23 bp, Artificial Sequence
  Synthetic
ccgttttttttttttacatactt

SEQ ID NO: 10210 - DNA, 23 bp, Artificial Sequence
  Synthetic
ccgttttttttttttacaagttc

SEQ ID NO: 10211 - DNA, 23 bp, Artificial Sequence
  Synthetic
ccgttttttttttttcttcagtt

SEQ ID NO: 10212 - DNA, 23 bp, Artificial Sequence
  Synthetic
ccgttttttttttttcatagccc

SEQ ID NO: 10213 - DNA, 23 bp, Artificial Sequence
  Synthetic
ccgttttttttttttgatagccc

SEQ ID NO: 10214 - DNA, 23 bp, Artificial Sequence
  Synthetic
ccgttttttttttttcacaaatt

SEQ ID NO: 10215 - DNA, 23 bp, Artificial Sequence
  Synthetic
ccgttttttttttttacaaattc

SEQ ID NO: 10216 - DNA, 23 bp, Artificial Sequence
  Synthetic
ccgttttttttttttacacaaac

SEQ ID NO: 10217 - DNA, 23 bp, Artificial Sequence
  Synthetic
ccgttttttttttttggcattca

SEQ ID NO: 10218 - DNA, 23 bp, Artificial Sequence
  Synthetic
ccgttttttttttttcacaagtt

SEQ ID NO: 10219 - DNA, 23 bp, Artificial Sequence
  Synthetic
ccgttttttttttttaaagagac

SEQ ID NO: 10220 - DNA, 23 bp, Artificial Sequence
  Synthetic
ccgttttttttttttagcaagcc

SEQ ID NO: 10221 - DNA, 23 bp, Artificial Sequence
  Synthetic
ccgttttttttttttatgccctt

SEQ ID NO: 10222 - DNA, 23 bp, Artificial Sequence
  Synthetic
ccgttttttttttttcgaccatg

SEQ ID NO: 10223 - DNA, 23 bp, Artificial Sequence
  Synthetic
ccgttttttttttttacagctgg

SEQ ID NO: 10224 - DNA, 23 bp, Artificial Sequence
  Synthetic
ccgttttttttttttcacatagg

SEQ ID NO: 10225 - DNA, 23 bp, Artificial Sequence
  Synthetic
ccgttttttttttttcacatagg

SEQ ID NO: 10226 - DNA, 23 bp, Artificial Sequence
  Synthetic
ccgttttttttttttctacgcgt

SEQ ID NO: 10227 - DNA, 23 bp, Artificial Sequence
  Synthetic
ccgttttttttttttgattcaca

SEQ ID NO: 10228 - DNA, 23 bp, Artificial Sequence
  Synthetic
ccgttttttttttttgcatcttt

SEQ ID NO: 10229 - DNA, 23 bp, Artificial Sequence
  Synthetic
ccgttttttttttttccataaag

SEQ ID NO: 10230 - DNA, 23 bp, Artificial Sequence
  Synthetic
ccgttttttttttttcgagctac

SEQ ID NO: 10231 - DNA, 23 bp, Artificial Sequence
  Synthetic
ccgttttttttttttccagtaca

SEQ ID NO: 10232 - DNA, 23 bp, Artificial Sequence
  Synthetic
ccgttttttttttttagggattc

SEQ ID NO: 10233 - DNA, 23 bp, Artificial Sequence
  Synthetic
ccgttttttttttttcccaagtt

SEQ ID NO: 10234 - DNA, 23 bp, Artificial Sequence
  Synthetic
ccgttttttttttttaacaaacc

SEQ ID NO: 10235 - DNA, 23 bp, Artificial Sequence
  Synthetic
ccgttttttttttttcgccaata

SEQ ID NO: 10236 - DNA, 23 bp, Artificial Sequence
  Synthetic
ccgttttttttttttacaagtgc

SEQ ID NO: 10237 - DNA, 23 bp, Artificial Sequence
  Synthetic
ccgttttttttttttactacctg

SEQ ID NO: 10238 - DNA, 23 bp, Artificial Sequence
  Synthetic
ccgttttttttttttatctgcac

SEQ ID NO: 10239 - DNA, 23 bp, Artificial Sequence
  Synthetic
ccgttttttttttttactcaccg

SEQ ID NO: 10240 - DNA, 23 bp, Artificial Sequence
  Synthetic
ccgttttttttttttcccaccga

SEQ ID NO: 10241 - DNA, 23 bp, Artificial Sequence
  Synthetic
ccgttttttttttttactcaccg

SEQ ID NO: 10242 - DNA, 23 bp, Artificial Sequence
  Synthetic
ccgttttttttttttgtgagttc

SEQ ID NO: 10243 - DNA, 23 bp, Artificial Sequence
  Synthetic
ccgttttttttttttcagtgaat

SEQ ID NO: 10244 - DNA, 23 bp, Artificial Sequence
  Synthetic
ccgttttttttttttacccttat

SEQ ID NO: 10245 - DNA, 23 bp, Artificial Sequence
  Synthetic
ccgttttttttttttaagcccaa

SEQ ID NO: 10246 - DNA, 23 bp, Artificial Sequence
  Synthetic
ccgttttttttttttggctgcaa

SEQ ID NO: 10247 - DNA, 23 bp, Artificial Sequence
  Synthetic
ccgttttttttttttagctgctt

SEQ ID NO: 10248 - DNA, 23 bp, Artificial Sequence
  Synthetic
ccgttttttttttttctgggact

SEQ ID NO: 10249 - DNA, 23 bp, Artificial Sequence
  Synthetic
ccgttttttttttttccaacaac

SEQ ID NO: 10250 - DNA, 23 bp, Artificial Sequence
  Synthetic
ccgttttttttttttgaacagat

SEQ ID NO: 10251 - DNA, 23 bp, Artificial Sequence
  Synthetic
ccgttttttttttttcagttttg

SEQ ID NO: 10252 - DNA, 23 bp, Artificial Sequence
  Synthetic
ccgttttttttttttcagttttg

SEQ ID NO: 10253 - DNA, 23 bp, Artificial Sequence
  Synthetic
ccgttttttttttttctacctgc

SEQ ID NO: 10254 - DNA, 23 bp, Artificial Sequence
  Synthetic
ccgttttttttttttacatcgtt

SEQ ID NO: 10255 - DNA, 23 bp, Artificial Sequence
  Synthetic
ccgttttttttttttccagcact

SEQ ID NO: 10256 - DNA, 23 bp, Artificial Sequence
  Synthetic
ccgttttttttttttcatcatta

SEQ ID NO: 10257 - DNA, 23 bp, Artificial Sequence
  Synthetic
ccgttttttttttttccatcatt

SEQ ID NO: 10258 - DNA, 23 bp, Artificial Sequence
  Synthetic
ccgttttttttttttcaagtggt

SEQ ID NO: 10259 - DNA, 23 bp, Artificial Sequence
  Synthetic
ccgttttttttttttaggcatag

SEQ ID NO: 10260 - DNA, 23 bp, Artificial Sequence
  Synthetic
ccgttttttttttttcacacact

SEQ ID NO: 10261 - DNA, 23 bp, Artificial Sequence
  Synthetic
ccgttttttttttttacgagctt

SEQ ID NO: 10262 - DNA, 23 bp, Artificial Sequence
  Synthetic
ccgttttttttttttcaacatca

SEQ ID NO: 10263 - DNA, 23 bp, Artificial Sequence
  Synthetic
ccgttttttttttttggccgtga

SEQ ID NO: 10264 - DNA, 23 bp, Artificial Sequence
  Synthetic
ccgttttttttttttctgcctgt

SEQ ID NO: 10265 - DNA, 23 bp, Artificial Sequence
  Synthetic
ccgttttttttttttcacagttg

SEQ ID NO: 10266 - DNA, 23 bp, Artificial Sequence
  Synthetic
ccgttttttttttttatccaatc

SEQ ID NO: 10267 - DNA, 23 bp, Artificial Sequence
  Synthetic
ccgttttttttttttacatggtt

SEQ ID NO: 10268 - DNA, 23 bp, Artificial Sequence
  Synthetic
ccgttttttttttttagaattgc

SEQ ID NO: 10269 - DNA, 23 bp, Artificial Sequence
  Synthetic
ccgttttttttttttgcagttct

SEQ ID NO: 10270 - DNA, 23 bp, Artificial Sequence
  Synthetic
ccgttttttttttttgaaaccca

SEQ ID NO: 10271 - DNA, 23 bp, Artificial Sequence
  Synthetic
ccgttttttttttttgagaccca

SEQ ID NO: 10272 - DNA, 23 bp, Artificial Sequence
  Synthetic
ccgttttttttttttggggtatt

SEQ ID NO: 10273 - DNA, 23 bp, Artificial Sequence
  Synthetic
ccgttttttttttttgaaatccc

SEQ ID NO: 10274 - DNA, 23 bp, Artificial Sequence
  Synthetic
ccgttttttttttttggtaatcc

SEQ ID NO: 10275 - DNA, 23 bp, Artificial Sequence
  Synthetic
ccgttttttttttttctgctgaa

SEQ ID NO: 10276 - DNA, 23 bp, Artificial Sequence
  Synthetic
ccgttttttttttttcagaccga

SEQ ID NO: 10277 - DNA, 23 bp, Artificial Sequence
  Synthetic
ccgttttttttttttgcggaact

SEQ ID NO: 10278 - DNA, 23 bp, Artificial Sequence
  Synthetic
ccgttttttttttttgcagaact

SEQ ID NO: 10279 - DNA, 23 bp, Artificial Sequence
  Synthetic
ccgttttttttttttaccgattt

SEQ ID NO: 10280 - DNA, 23 bp, Artificial Sequence
  Synthetic
ccgttttttttttttactgattt

SEQ ID NO: 10281 - DNA, 23 bp, Artificial Sequence
  Synthetic
ccgttttttttttttctaaaaca

SEQ ID NO: 10282 - DNA, 23 bp, Artificial Sequence
  Synthetic
ccgttttttttttttccaaaaca

SEQ ID NO: 10283 - DNA, 23 bp, Artificial Sequence
  Synthetic
ccgttttttttttttactgaaac

SEQ ID NO: 10284 - DNA, 23 bp, Artificial Sequence
  Synthetic
ccgttttttttttttactcaaac

SEQ ID NO: 10285 - DNA, 23 bp, Artificial Sequence
  Synthetic
ccgttttttttttttcttccagt

SEQ ID NO: 10286 - DNA, 23 bp, Artificial Sequence
  Synthetic
ccgttttttttttttcagctatg

SEQ ID NO: 10287 - DNA, 23 bp, Artificial Sequence
  Synthetic
ccgttttttttttttgcaactta

SEQ ID NO: 10288 - DNA, 23 bp, Artificial Sequence
  Synthetic
ccgttttttttttttcaacaaaa

SEQ ID NO: 10289 - DNA, 23 bp, Artificial Sequence
  Synthetic
ccgttttttttttttaacaacca

SEQ ID NO: 10290 - DNA, 23 bp, Artificial Sequence
  Synthetic
ccgttttttttttttataaggat

SEQ ID NO: 10291 - DNA, 23 bp, Artificial Sequence
  Synthetic
ccgttttttttttttcaccattg

SEQ ID NO: 10292 - DNA, 23 bp, Artificial Sequence
  Synthetic
ccgttttttttttttcacgcgag

SEQ ID NO: 10293 - DNA, 23 bp, Artificial Sequence
  Synthetic
ccgttttttttttttagccacaa

SEQ ID NO: 10294 - DNA, 23 bp, Artificial Sequence
  Synthetic
ccgttttttttttttggacggac

SEQ ID NO: 10295 - DNA, 23 bp, Artificial Sequence
  Synthetic
ccgttttttttttttaccagcta

SEQ ID NO: 10296 - DNA, 23 bp, Artificial Sequence
  Synthetic
ccgttttttttttttaacacagt

SEQ ID NO: 10297 - DNA, 23 bp, Artificial Sequence
  Synthetic
ccgttttttttttttcaacaaaa

SEQ ID NO: 10298 - DNA, 23 bp, Artificial Sequence
  Synthetic
ccgttttttttttttcatacagc

SEQ ID NO: 10299 - DNA, 23 bp, Artificial Sequence
  Synthetic
ccgttttttttttttactttcgg

SEQ ID NO: 10300 - DNA, 23 bp, Artificial Sequence
  Synthetic
ccgttttttttttttcaggccgg

SEQ ID NO: 10301 - DNA, 23 bp, Artificial Sequence
  Synthetic
ccgttttttttttttctacctgc

SEQ ID NO: 10302 - DNA, 23 bp, Artificial Sequence
  Synthetic
ccgttttttttttttagcaaaaa

SEQ ID NO: 10303 - DNA, 23 bp, Artificial Sequence
  Synthetic
ccgttttttttttttgccgcaca

SEQ ID NO: 10304 - DNA, 23 bp, Artificial Sequence
  Synthetic
ccgttttttttttttcggactac

SEQ ID NO: 10305 - DNA, 23 bp, Artificial Sequence
  Synthetic
ccgttttttttttttaagctatt

SEQ ID NO: 10306 - DNA, 23 bp, Artificial Sequence
  Synthetic
ccgttttttttttttgcgggaga

SEQ ID NO: 10307 - DNA, 23 bp, Artificial Sequence
  Synthetic
ccgttttttttttttgaagggtt

SEQ ID NO: 10308 - DNA, 23 bp, Artificial Sequence
  Synthetic
ccgttttttttttttggtcatgc

SEQ ID NO: 10309 - DNA, 23 bp, Artificial Sequence
  Synthetic
ccgttttttttttttacagtaga

SEQ ID NO: 10310 - DNA, 23 bp, Artificial Sequence
  Synthetic
ccgttttttttttttactgtcat

SEQ ID NO: 10311 - DNA, 23 bp, Artificial Sequence
  Synthetic
ccgttttttttttttctgtaatc

SEQ ID NO: 10312 - DNA, 23 bp, Artificial Sequence
  Synthetic
ccgttttttttttttactattgt

SEQ ID NO: 10313 - DNA, 23 bp, Artificial Sequence
  Synthetic
ccgttttttttttttaaaggaag

SEQ ID NO: 10314 - DNA, 23 bp, Artificial Sequence
  Synthetic
ccgttttttttttttaaagaggg

SEQ ID NO: 10315 - DNA, 23 bp, Artificial Sequence
  Synthetic
ccgttttttttttttaagcgcaa

SEQ ID NO: 10316 - DNA, 23 bp, Artificial Sequence
  Synthetic
ccgttttttttttttagaataac

SEQ ID NO: 10317 - DNA, 23 bp, Artificial Sequence
  Synthetic
ccgttttttttttttgagacgac

SEQ ID NO: 10318 - DNA, 23 bp, Artificial Sequence
  Synthetic
ccgttttttttttttaaaaccac

SEQ ID NO: 10319 - DNA, 23 bp, Artificial Sequence
  Synthetic
ccgttttttttttttaataaagg

SEQ ID NO: 10320 - DNA, 23 bp, Artificial Sequence
  Synthetic
ccgttttttttttttaggttacc

SEQ ID NO: 10321 - DNA, 23 bp, Artificial Sequence
  Synthetic
ccgttttttttttttgaccaaac

SEQ ID NO: 10322 - DNA, 23 bp, Artificial Sequence
  Synthetic
ccgttttttttttttaaaaaggt

SEQ ID NO: 10323 - DNA, 23 bp, Artificial Sequence
  Synthetic
ccgttttttttttttcacaagtt

SEQ ID NO: 10324 - DNA, 23 bp, Artificial Sequence
  Synthetic
ccgttttttttttttcttcagtt

SEQ ID NO: 10325 - DNA, 23 bp, Artificial Sequence
  Synthetic
ccgttttttttttttcatagccc

SEQ ID NO: 10326 - DNA, 23 bp, Artificial Sequence
  Synthetic
ccgttttttttttttacaggagt

SEQ ID NO: 10327 - DNA, 23 bp, Artificial Sequence
  Synthetic
ccgttttttttttttgctacctg

SEQ ID NO: 10328 - DNA, 23 bp, Artificial Sequence
  Synthetic
ccgttttttttttttatctgcac

SEQ ID NO: 10329 - DNA, 23 bp, Artificial Sequence
  Synthetic
ccgttttttttttttgatagccc

SEQ ID NO: 10330 - DNA, 23 bp, Artificial Sequence
  Synthetic
ccgttttttttttttggcattca

SEQ ID NO: 10331 - DNA, 23 bp, Artificial Sequence
  Synthetic
ccgttttttttttttcacaagtt

SEQ ID NO: 10332 - DNA, 23 bp, Artificial Sequence
  Synthetic
ccgttttttttttttagccaagc

SEQ ID NO: 10333 - DNA, 23 bp, Artificial Sequence
  Synthetic
ccgttttttttttttaaaagaga

SEQ ID NO: 10334 - DNA, 23 bp, Artificial Sequence
  Synthetic
ccgttttttttttttgccctttt

SEQ ID NO: 10335 - DNA, 23 bp, Artificial Sequence
  Synthetic
ccgttttttttttttacagctgg

SEQ ID NO: 10336 - DNA, 23 bp, Artificial Sequence
  Synthetic
ccgttttttttttttcacatagg

SEQ ID NO: 10337 - DNA, 23 bp, Artificial Sequence
  Synthetic
ccgttttttttttttccatcttt

SEQ ID NO: 10338 - DNA, 23 bp, Artificial Sequence
  Synthetic
ccgttttttttttttaagggatt

SEQ ID NO: 10339 - DNA, 23 bp, Artificial Sequence
  Synthetic
ccgttttttttttttcacttttg

SEQ ID NO: 10340 - DNA, 23 bp, Artificial Sequence
  Synthetic
ccgttttttttttttcacaaacc

SEQ ID NO: 10341 - DNA, 23 bp, Artificial Sequence
  Synthetic
ccgttttttttttttgtaaacca

SEQ ID NO: 10342 - DNA, 23 bp, Artificial Sequence
  Synthetic
ccgttttttttttttcgccaata

SEQ ID NO: 10343 - DNA, 23 bp, Artificial Sequence
  Synthetic
ccgttttttttttttacaagtgc

SEQ ID NO: 10344 - DNA, 23 bp, Artificial Sequence
  Synthetic
ccgttttttttttttactacctg

SEQ ID NO: 10345 - DNA, 23 bp, Artificial Sequence
  Synthetic
ccgttttttttttttatctgcac

SEQ ID NO: 10346 - DNA, 23 bp, Artificial Sequence
  Synthetic
ccgttttttttttttactcaccg

SEQ ID NO: 10347 - DNA, 23 bp, Artificial Sequence
  Synthetic
ccgttttttttttttggtacaat

SEQ ID NO: 10348 - DNA, 23 bp, Artificial Sequence
  Synthetic
ccgttttttttttttaacccacc

SEQ ID NO: 10349 - DNA, 23 bp, Artificial Sequence
  Synthetic
ccgttttttttttttactcaccg

SEQ ID NO: 10350 - DNA, 23 bp, Artificial Sequence
  Synthetic
ccgttttttttttttgtgagttc

SEQ ID NO: 10351 - DNA, 23 bp, Artificial Sequence
  Synthetic
ccgttttttttttttcagtgaat

SEQ ID NO: 10352 - DNA, 23 bp, Artificial Sequence
  Synthetic
ccgttttttttttttaccctcca

SEQ ID NO: 10353 - DNA, 23 bp, Artificial Sequence
  Synthetic
ccgttttttttttttactgatat

SEQ ID NO: 10354 - DNA, 23 bp, Artificial Sequence
  Synthetic
ccgttttttttttttacctaata

SEQ ID NO: 10355 - DNA, 23 bp, Artificial Sequence
  Synthetic
ccgttttttttttttccacatgg

SEQ ID NO: 10356 - DNA, 23 bp, Artificial Sequence
  Synthetic
ccgttttttttttttccaacaac

SEQ ID NO: 10357 - DNA, 23 bp, Artificial Sequence
  Synthetic
ccgttttttttttttcctatttc

SEQ ID NO: 10358 - DNA, 23 bp, Artificial Sequence
  Synthetic
ccgttttttttttttgaacaggt

SEQ ID NO: 10359 - DNA, 23 bp, Artificial Sequence
  Synthetic
ccgttttttttttttcagttttg

SEQ ID NO: 10360 - DNA, 23 bp, Artificial Sequence
  Synthetic
ccgttttttttttttcagttttg

SEQ ID NO: 10361 - DNA, 23 bp, Artificial Sequence
  Synthetic
ccgttttttttttttacctgcac

SEQ ID NO: 10362 - DNA, 23 bp, Artificial Sequence
  Synthetic
ccgttttttttttttccatcatt

SEQ ID NO: 10363 - DNA, 23 bp, Artificial Sequence
  Synthetic
ccgttttttttttttcaacatca

SEQ ID NO: 10364 - DNA, 23 bp, Artificial Sequence
  Synthetic
ccgttttttttttttaggcaaag

SEQ ID NO: 10365 - DNA, 23 bp, Artificial Sequence
  Synthetic
ccgttttttttttttctgcctgt

SEQ ID NO: 10366 - DNA, 23 bp, Artificial Sequence
  Synthetic
ccgttttttttttttgtctgtca

SEQ ID NO: 10367 - DNA, 23 bp, Artificial Sequence
  Synthetic
ccgttttttttttttacatggtt

SEQ ID NO: 10368 - DNA, 23 bp, Artificial Sequence
  Synthetic
ccgttttttttttttagaattgc

SEQ ID NO: 10369 - DNA, 23 bp, Artificial Sequence
  Synthetic
ccgttttttttttttacagttct

SEQ ID NO: 10370 - DNA, 23 bp, Artificial Sequence
  Synthetic
ccgttttttttttttaaagtgtc

SEQ ID NO: 10371 - DNA, 23 bp, Artificial Sequence
  Synthetic
ccgttttttttttttgaaaccca

SEQ ID NO: 10372 - DNA, 23 bp, Artificial Sequence
  Synthetic
ccgttttttttttttggggtatt

SEQ ID NO: 10373 - DNA, 23 bp, Artificial Sequence
  Synthetic
ccgttttttttttttaaacggaa

SEQ ID NO: 10374 - DNA, 23 bp, Artificial Sequence
  Synthetic
ccgttttttttttttggaaatcc

SEQ ID NO: 10375 - DNA, 23 bp, Artificial Sequence
  Synthetic
ccgttttttttttttctgttcct

SEQ ID NO: 10376 - DNA, 23 bp, Artificial Sequence
  Synthetic
ccgttttttttttttcagaccga

SEQ ID NO: 10377 - DNA, 23 bp, Artificial Sequence
  Synthetic
ccgttttttttttttagcctatc

SEQ ID NO: 10378 - DNA, 23 bp, Artificial Sequence
  Synthetic
ccgttttttttttttggcggaac

SEQ ID NO: 10379 - DNA, 23 bp, Artificial Sequence
  Synthetic
ccgttttttttttttctcaatag

SEQ ID NO: 10380 - DNA, 23 bp, Artificial Sequence
  Synthetic
ccgttttttttttttaaccgatt

SEQ ID NO: 10381 - DNA, 23 bp, Artificial Sequence
  Synthetic
ccgttttttttttttgctgcaaa

SEQ ID NO: 10382 - DNA, 23 bp, Artificial Sequence
  Synthetic
ccgttttttttttttcttccagt

SEQ ID NO: 10383 - DNA, 23 bp, Artificial Sequence
  Synthetic
ccgttttttttttttgctgagtg

SEQ ID NO: 10384 - DNA, 23 bp, Artificial Sequence
  Synthetic
ccgttttttttttttcagctatg

SEQ ID NO: 10385 - DNA, 23 bp, Artificial Sequence
  Synthetic
ccgttttttttttttgcaactta

SEQ ID NO: 10386 - DNA, 23 bp, Artificial Sequence
  Synthetic
ccgttttttttttttcaatgcaa

SEQ ID NO: 10387 - DNA, 23 bp, Artificial Sequence
  Synthetic
ccgttttttttttttacaaccag

SEQ ID NO: 10388 - DNA, 23 bp, Artificial Sequence
  Synthetic
ccgttttttttttttacaggccg

SEQ ID NO: 10389 - DNA, 23 bp, Artificial Sequence
  Synthetic
ccgttttttttttttctacctgc

SEQ ID NO: 10390 - DNA, 23 bp, Artificial Sequence
  Synthetic
ccgttttttttttttgcaaaaat

SEQ ID NO: 10391 - DNA, 23 bp, Artificial Sequence
  Synthetic
ccgttttttttttttaacaatac

SEQ ID NO: 10392 - DNA, 23 bp, Artificial Sequence
  Synthetic
ccgttttttttttttcacaagat

SEQ ID NO: 10393 - DNA, 23 bp, Artificial Sequence
  Synthetic
ccgttttttttttttactataca

SEQ ID NO: 10394 - DNA, 23 bp, Artificial Sequence
  Synthetic
ccgttttttttttttaaccacac

SEQ ID NO: 10395 - DNA, 23 bp, Artificial Sequence
  Synthetic
ccgttttttttttttaaccatac

SEQ ID NO: 10396 - DNA, 23 bp, Artificial Sequence
  Synthetic
ccgttttttttttttactatgca

SEQ ID NO: 10397 - DNA, 23 bp, Artificial Sequence
  Synthetic
ccgttttttttttttagaaaggc

SEQ ID NO: 10398 - DNA, 23 bp, Artificial Sequence
  Synthetic
ccgttttttttttttactataca

SEQ ID NO: 10399 - DNA, 23 bp, Artificial Sequence
  Synthetic
ccgttttttttttttactataca

SEQ ID NO: 10400 - DNA, 23 bp, Artificial Sequence
  Synthetic
ccgttttttttttttactgtaca

SEQ ID NO: 10401 - DNA, 23 bp, Artificial Sequence
  Synthetic
ccgttttttttttttacagcaca

SEQ ID NO: 10402 - DNA, 23 bp, Artificial Sequence
  Synthetic
ccgttttttttttttacatactt

SEQ ID NO: 10403 - DNA, 23 bp, Artificial Sequence
  Synthetic
ccgttttttttttttcacaagtt

SEQ ID NO: 10404 - DNA, 23 bp, Artificial Sequence
  Synthetic
ccgttttttttttttcttcagtt

SEQ ID NO: 10405 - DNA, 23 bp, Artificial Sequence
  Synthetic
ccgttttttttttttcttcagct

SEQ ID NO: 10406 - DNA, 23 bp, Artificial Sequence
  Synthetic
ccgttttttttttttcatagccc

SEQ ID NO: 10407 - DNA, 23 bp, Artificial Sequence
  Synthetic
ccgttttttttttttacctgcac

SEQ ID NO: 10408 - DNA, 23 bp, Artificial Sequence
  Synthetic
ccgttttttttttttatctgcac

SEQ ID NO: 10409 - DNA, 23 bp, Artificial Sequence
  Synthetic
ccgttttttttttttgatagccc

SEQ ID NO: 10410 - DNA, 23 bp, Artificial Sequence
  Synthetic
ccgttttttttttttcacaaatt

SEQ ID NO: 10411 - DNA, 23 bp, Artificial Sequence
  Synthetic
ccgttttttttttttacacaaat

SEQ ID NO: 10412 - DNA, 23 bp, Artificial Sequence
  Synthetic
ccgttttttttttttacaaacac

SEQ ID NO: 10413 - DNA, 23 bp, Artificial Sequence
  Synthetic
ccgttttttttttttggcattca

SEQ ID NO: 10414 - DNA, 23 bp, Artificial Sequence
  Synthetic
ccgttttttttttttcacaggtt

SEQ ID NO: 10415 - DNA, 23 bp, Artificial Sequence
  Synthetic
ccgttttttttttttcacaagtt

SEQ ID NO: 10416 - DNA, 23 bp, Artificial Sequence
  Synthetic
ccgttttttttttttgcattatt

SEQ ID NO: 10417 - DNA, 23 bp, Artificial Sequence
  Synthetic
ccgttttttttttttcgcgtacc

SEQ ID NO: 10418 - DNA, 23 bp, Artificial Sequence
  Synthetic
ccgttttttttttttgccaagct

SEQ ID NO: 10419 - DNA, 23 bp, Artificial Sequence
  Synthetic
ccgttttttttttttaaaagaga

SEQ ID NO: 10420 - DNA, 23 bp, Artificial Sequence
  Synthetic
ccgttttttttttttgaaagaga

SEQ ID NO: 10421 - DNA, 23 bp, Artificial Sequence
  Synthetic
ccgttttttttttttatgctttt

SEQ ID NO: 10422 - DNA, 23 bp, Artificial Sequence
  Synthetic
ccgttttttttttttagcaagcc

SEQ ID NO: 10423 - DNA, 23 bp, Artificial Sequence
  Synthetic
ccgttttttttttttatgccctt

SEQ ID NO: 10424 - DNA, 23 bp, Artificial Sequence
  Synthetic
ccgttttttttttttatgccctt

SEQ ID NO: 10425 - DNA, 23 bp, Artificial Sequence
  Synthetic
ccgttttttttttttcgaccatg

SEQ ID NO: 10426 - DNA, 23 bp, Artificial Sequence
  Synthetic
ccgttttttttttttacagctgg

SEQ ID NO: 10427 - DNA, 23 bp, Artificial Sequence
  Synthetic
ccgttttttttttttatttggtt

SEQ ID NO: 10428 - DNA, 23 bp, Artificial Sequence
  Synthetic
ccgttttttttttttagctggtt

SEQ ID NO: 10429 - DNA, 23 bp, Artificial Sequence
  Synthetic
ccgttttttttttttcccctctg

SEQ ID NO: 10430 - DNA, 23 bp, Artificial Sequence
  Synthetic
ccgttttttttttttcacatagg

SEQ ID NO: 10431 - DNA, 23 bp, Artificial Sequence
  Synthetic
ccgttttttttttttcacatagg

SEQ ID NO: 10432 - DNA, 23 bp, Artificial Sequence
  Synthetic
ccgttttttttttttccatcatc

SEQ ID NO: 10433 - DNA, 23 bp, Artificial Sequence
  Synthetic
ccgttttttttttttctacgcgt

SEQ ID NO: 10434 - DNA, 23 bp, Artificial Sequence
  Synthetic
ccgttttttttttttgattcaca

SEQ ID NO: 10435 - DNA, 23 bp, Artificial Sequence
  Synthetic
ccgttttttttttttagacacgt

SEQ ID NO: 10436 - DNA, 23 bp, Artificial Sequence
  Synthetic
ccgttttttttttttctaccata

SEQ ID NO: 10437 - DNA, 23 bp, Artificial Sequence
  Synthetic
ccgttttttttttttccgtggtt

SEQ ID NO: 10438 - DNA, 23 bp, Artificial Sequence
  Synthetic
ccgttttttttttttccatcttt

SEQ ID NO: 10439 - DNA, 23 bp, Artificial Sequence
  Synthetic
ccgttttttttttttccataaag

SEQ ID NO: 10440 - DNA, 23 bp, Artificial Sequence
  Synthetic
ccgttttttttttttgtagtgct

SEQ ID NO: 10441 - DNA, 23 bp, Artificial Sequence
  Synthetic
ccgttttttttttttgagctaca

SEQ ID NO: 10442 - DNA, 23 bp, Artificial Sequence
  Synthetic
ccgttttttttttttctagtaca

SEQ ID NO: 10443 - DNA, 23 bp, Artificial Sequence
  Synthetic
ccgttttttttttttaagggatt

SEQ ID NO: 10444 - DNA, 23 bp, Artificial Sequence
  Synthetic
ccgttttttttttttaacccatg

SEQ ID NO: 10445 - DNA, 23 bp, Artificial Sequence
  Synthetic
ccgttttttttttttagcctatg

SEQ ID NO: 10446 - DNA, 23 bp, Artificial Sequence
  Synthetic
ccgttttttttttttacaaagtt

SEQ ID NO: 10447 - DNA, 23 bp, Artificial Sequence
  Synthetic
ccgttttttttttttacaaagtt

SEQ ID NO: 10448 - DNA, 23 bp, Artificial Sequence
  Synthetic
ccgttttttttttttggagtgaa

SEQ ID NO: 10449 - DNA, 23 bp, Artificial Sequence
  Synthetic
ccgttttttttttttcactggta

SEQ ID NO: 10450 - DNA, 23 bp, Artificial Sequence
  Synthetic
ccgttttttttttttcctcaagg

SEQ ID NO: 10451 - DNA, 23 bp, Artificial Sequence
  Synthetic
ccgttttttttttttcccaagtt

SEQ ID NO: 10452 - DNA, 23 bp, Artificial Sequence
  Synthetic
ccgttttttttttttgatcactt

SEQ ID NO: 10453 - DNA, 23 bp, Artificial Sequence
  Synthetic
ccgttttttttttttcgaaggca

SEQ ID NO: 10454 - DNA, 23 bp, Artificial Sequence
  Synthetic
ccgttttttttttttcccctatc

SEQ ID NO: 10455 - DNA, 23 bp, Artificial Sequence
  Synthetic
ccgttttttttttttcacaaacc

SEQ ID NO: 10456 - DNA, 23 bp, Artificial Sequence
  Synthetic
ccgttttttttttttgtaaacca

SEQ ID NO: 10457 - DNA, 23 bp, Artificial Sequence
  Synthetic
ccgttttttttttttcgccaata

SEQ ID NO: 10458 - DNA, 23 bp, Artificial Sequence
  Synthetic
ccgttttttttttttacaagtgc

SEQ ID NO: 10459 - DNA, 23 bp, Artificial Sequence
  Synthetic
ccgttttttttttttactacctg

SEQ ID NO: 10460 - DNA, 23 bp, Artificial Sequence
  Synthetic
ccgttttttttttttatctgcac

SEQ ID NO: 10461 - DNA, 23 bp, Artificial Sequence
  Synthetic
ccgttttttttttttactcaccg

SEQ ID NO: 10462 - DNA, 23 bp, Artificial Sequence
  Synthetic
ccgttttttttttttggtacaat

SEQ ID NO: 10463 - DNA, 23 bp, Artificial Sequence
  Synthetic
ccgttttttttttttcccaccga

SEQ ID NO: 10464 - DNA, 23 bp, Artificial Sequence
  Synthetic
ccgttttttttttttactcaccg

SEQ ID NO: 10465 - DNA, 23 bp, Artificial Sequence
  Synthetic
ccgttttttttttttgtgagttc

SEQ ID NO: 10466 - DNA, 23 bp, Artificial Sequence
  Synthetic
ccgttttttttttttcagtgaat

SEQ ID NO: 10467 - DNA, 23 bp, Artificial Sequence
  Synthetic
ccgttttttttttttacccttat

SEQ ID NO: 10468 - DNA, 23 bp, Artificial Sequence
  Synthetic
ccgttttttttttttgaactgcc

SEQ ID NO: 10469 - DNA, 23 bp, Artificial Sequence
  Synthetic
ccgttttttttttttaagcccaa

SEQ ID NO: 10470 - DNA, 23 bp, Artificial Sequence
  Synthetic
ccgttttttttttttccggctgc

SEQ ID NO: 10471 - DNA, 23 bp, Artificial Sequence
  Synthetic
ccgttttttttttttaccctcca

SEQ ID NO: 10472 - DNA, 23 bp, Artificial Sequence
  Synthetic
ccgttttttttttttactgatat

SEQ ID NO: 10473 - DNA, 23 bp, Artificial Sequence
  Synthetic
ccgttttttttttttacctaata

SEQ ID NO: 10474 - DNA, 23 bp, Artificial Sequence
  Synthetic
ccgttttttttttttagctgctt

SEQ ID NO: 10475 - DNA, 23 bp, Artificial Sequence
  Synthetic
ccgttttttttttttgtcaattc

SEQ ID NO: 10476 - DNA, 23 bp, Artificial Sequence
  Synthetic
ccgttttttttttttctgggact

SEQ ID NO: 10477 - DNA, 23 bp, Artificial Sequence
  Synthetic
ccgttttttttttttccacatgg

SEQ ID NO: 10478 - DNA, 23 bp, Artificial Sequence
  Synthetic
ccgttttttttttttgccaatat

SEQ ID NO: 10479 - DNA, 23 bp, Artificial Sequence
  Synthetic
ccgttttttttttttccaacaac

SEQ ID NO: 10480 - DNA, 23 bp, Artificial Sequence
  Synthetic
ccgttttttttttttccaacaac

SEQ ID NO: 10481 - DNA, 23 bp, Artificial Sequence
  Synthetic
ccgttttttttttttgaacaggt

SEQ ID NO: 10482 - DNA, 23 bp, Artificial Sequence
  Synthetic
ccgttttttttttttaaccaatg

SEQ ID NO: 10483 - DNA, 23 bp, Artificial Sequence
  Synthetic
ccgttttttttttttgaacaggt

SEQ ID NO: 10484 - DNA, 23 bp, Artificial Sequence
  Synthetic
ccgttttttttttttcagttttg

SEQ ID NO: 10485 - DNA, 23 bp, Artificial Sequence
  Synthetic
ccgttttttttttttcagttttg

SEQ ID NO: 10486 - DNA, 23 bp, Artificial Sequence
  Synthetic
ccgttttttttttttacatcgtt

SEQ ID NO: 10487 - DNA, 23 bp, Artificial Sequence
  Synthetic
ccgttttttttttttgtcatcat

SEQ ID NO: 10488 - DNA, 23 bp, Artificial Sequence
  Synthetic
ccgttttttttttttccatcatt

SEQ ID NO: 10489 - DNA, 23 bp, Artificial Sequence
  Synthetic
ccgttttttttttttagaacaat

SEQ ID NO: 10490 - DNA, 23 bp, Artificial Sequence
  Synthetic
ccgttttttttttttcttcccat

SEQ ID NO: 10491 - DNA, 23 bp, Artificial Sequence
  Synthetic
ccgttttttttttttctagtggt

SEQ ID NO: 10492 - DNA, 23 bp, Artificial Sequence
  Synthetic
ccgttttttttttttcaggcata

SEQ ID NO: 10493 - DNA, 23 bp, Artificial Sequence
  Synthetic
ccgttttttttttttcagactcc

SEQ ID NO: 10494 - DNA, 23 bp, Artificial Sequence
  Synthetic
ccgttttttttttttccacacac

SEQ ID NO: 10495 - DNA, 23 bp, Artificial Sequence
  Synthetic
ccgttttttttttttgagggagg

SEQ ID NO: 10496 - DNA, 23 bp, Artificial Sequence
  Synthetic
ccgttttttttttttacaagctt

SEQ ID NO: 10497 - DNA, 23 bp, Artificial Sequence
  Synthetic
ccgttttttttttttctacctgc

SEQ ID NO: 10498 - DNA, 23 bp, Artificial Sequence
  Synthetic
ccgttttttttttttacctgcac

SEQ ID NO: 10499 - DNA, 23 bp, Artificial Sequence
  Synthetic
ccgttttttttttttcaacatca

SEQ ID NO: 10500 - DNA, 23 bp, Artificial Sequence
  Synthetic
ccgttttttttttttcagccgct

SEQ ID NO: 10501 - DNA, 23 bp, Artificial Sequence
  Synthetic
ccgttttttttttttaggcaaag

SEQ ID NO: 10502 - DNA, 23 bp, Artificial Sequence
  Synthetic
ccgttttttttttttggccgtga

SEQ ID NO: 10503 - DNA, 23 bp, Artificial Sequence
  Synthetic
ccgttttttttttttctgcctgt

SEQ ID NO: 10504 - DNA, 23 bp, Artificial Sequence
  Synthetic
ccgttttttttttttgtctgtca

SEQ ID NO: 10505 - DNA, 23 bp, Artificial Sequence
  Synthetic
ccgttttttttttttcacagttg

SEQ ID NO: 10506 - DNA, 23 bp, Artificial Sequence
  Synthetic
ccgttttttttttttcacatttg

SEQ ID NO: 10507 - DNA, 23 bp, Artificial Sequence
  Synthetic
ccgttttttttttttatccagtc

SEQ ID NO: 10508 - DNA, 23 bp, Artificial Sequence
  Synthetic
ccgttttttttttttacatggtt

SEQ ID NO: 10509 - DNA, 23 bp, Artificial Sequence
  Synthetic
ccgttttttttttttagaattgc

SEQ ID NO: 10510 - DNA, 23 bp, Artificial Sequence
  Synthetic
ccgttttttttttttacagttct

SEQ ID NO: 10511 - DNA, 23 bp, Artificial Sequence
  Synthetic
ccgttttttttttttaaacccag

SEQ ID NO: 10512 - DNA, 23 bp, Artificial Sequence
  Synthetic
ccgttttttttttttgagaccca

SEQ ID NO: 10513 - DNA, 23 bp, Artificial Sequence
  Synthetic
ccgttttttttttttggggtatt

SEQ ID NO: 10514 - DNA, 23 bp, Artificial Sequence
  Synthetic
ccgttttttttttttaaacggaa

SEQ ID NO: 10515 - DNA, 23 bp, Artificial Sequence
  Synthetic
ccgttttttttttttggaaatcc

SEQ ID NO: 10516 - DNA, 23 bp, Artificial Sequence
  Synthetic
ccgttttttttttttggtaatcc

SEQ ID NO: 10517 - DNA, 23 bp, Artificial Sequence
  Synthetic
ccgttttttttttttctgttcct

SEQ ID NO: 10518 - DNA, 23 bp, Artificial Sequence
  Synthetic
ccgttttttttttttcagaccga

SEQ ID NO: 10519 - DNA, 23 bp, Artificial Sequence
  Synthetic
ccgttttttttttttgcctatcc

SEQ ID NO: 10520 - DNA, 23 bp, Artificial Sequence
  Synthetic
ccgttttttttttttaacctatc

SEQ ID NO: 10521 - DNA, 23 bp, Artificial Sequence
  Synthetic
ccgttttttttttttgcggaact

SEQ ID NO: 10522 - DNA, 23 bp, Artificial Sequence
  Synthetic
ccgttttttttttttgcagaact

SEQ ID NO: 10523 - DNA, 23 bp, Artificial Sequence
  Synthetic
ccgttttttttttttctcaatag

SEQ ID NO: 10524 - DNA, 23 bp, Artificial Sequence
  Synthetic
ccgttttttttttttaaaaagtg

SEQ ID NO: 10525 - DNA, 23 bp, Artificial Sequence
  Synthetic
ccgttttttttttttggcacaca

SEQ ID NO: 10526 - DNA, 23 bp, Artificial Sequence
  Synthetic
ccgttttttttttttagagaggg

SEQ ID NO: 10527 - DNA, 23 bp, Artificial Sequence
  Synthetic
ccgttttttttttttgacaaaca

SEQ ID NO: 10528 - DNA, 23 bp, Artificial Sequence
  Synthetic
ccgttttttttttttgagagggc

SEQ ID NO: 10529 - DNA, 23 bp, Artificial Sequence
  Synthetic
ccgttttttttttttacactcaa

SEQ ID NO: 10530 - DNA, 23 bp, Artificial Sequence
  Synthetic
ccgttttttttttttcaaaagag

SEQ ID NO: 10531 - DNA, 23 bp, Artificial Sequence
  Synthetic
ccgttttttttttttacactaca

SEQ ID NO: 10532 - DNA, 23 bp, Artificial Sequence
  Synthetic
ccgttttttttttttacacacaa

SEQ ID NO: 10533 - DNA, 23 bp, Artificial Sequence
  Synthetic
ccgttttttttttttagactcaa

SEQ ID NO: 10534 - DNA, 23 bp, Artificial Sequence
  Synthetic
ccgttttttttttttacaggatt

SEQ ID NO: 10535 - DNA, 23 bp, Artificial Sequence
  Synthetic
ccgttttttttttttcatgcaca

SEQ ID NO: 10536 - DNA, 23 bp, Artificial Sequence
  Synthetic
ccgttttttttttttacatgttc

SEQ ID NO: 10537 - DNA, 23 bp, Artificial Sequence
  Synthetic
ccgttttttttttttggaagaac

SEQ ID NO: 10538 - DNA, 23 bp, Artificial Sequence
  Synthetic
ccgttttttttttttatgtatgt

SEQ ID NO: 10539 - DNA, 23 bp, Artificial Sequence
  Synthetic
ccgttttttttttttaaccgatt

SEQ ID NO: 10540 - DNA, 23 bp, Artificial Sequence
  Synthetic
ccgttttttttttttaacactga

SEQ ID NO: 10541 - DNA, 23 bp, Artificial Sequence
  Synthetic
ccgttttttttttttaccgattt

SEQ ID NO: 10542 - DNA, 23 bp, Artificial Sequence
  Synthetic
ccgttttttttttttgaagagag

SEQ ID NO: 10543 - DNA, 23 bp, Artificial Sequence
  Synthetic
ccgttttttttttttgctttgac

SEQ ID NO: 10544 - DNA, 23 bp, Artificial Sequence
  Synthetic
ccgttttttttttttgctttgac

SEQ ID NO: 10545 - DNA, 23 bp, Artificial Sequence
  Synthetic
ccgttttttttttttcaccaaaa

SEQ ID NO: 10546 - DNA, 23 bp, Artificial Sequence
  Synthetic
ccgttttttttttttctactaaa

SEQ ID NO: 10547 - DNA, 23 bp, Artificial Sequence
  Synthetic
ccgttttttttttttagaaagca

SEQ ID NO: 10548 - DNA, 23 bp, Artificial Sequence
  Synthetic
ccgttttttttttttccactgaa

SEQ ID NO: 10549 - DNA, 23 bp, Artificial Sequence
  Synthetic
ccgttttttttttttcagcaggt

SEQ ID NO: 10550 - DNA, 23 bp, Artificial Sequence
  Synthetic
ccgttttttttttttacactcaa

SEQ ID NO: 10551 - DNA, 23 bp, Artificial Sequence
  Synthetic
ccgttttttttttttgctgcaaa

SEQ ID NO: 10552 - DNA, 23 bp, Artificial Sequence
  Synthetic
ccgttttttttttttcttccagt

SEQ ID NO: 10553 - DNA, 23 bp, Artificial Sequence
  Synthetic
ccgttttttttttttagctgagt

SEQ ID NO: 10554 - DNA, 23 bp, Artificial Sequence
  Synthetic
ccgttttttttttttgctgagag

SEQ ID NO: 10555 - DNA, 23 bp, Artificial Sequence
  Synthetic
ccgttttttttttttcttccagt

SEQ ID NO: 10556 - DNA, 23 bp, Artificial Sequence
  Synthetic
ccgttttttttttttccagtcaa

SEQ ID NO: 10557 - DNA, 23 bp, Artificial Sequence
  Synthetic
ccgttttttttttttctgtaaac

SEQ ID NO: 10558 - DNA, 23 bp, Artificial Sequence
  Synthetic
ccgttttttttttttcagctatg

SEQ ID NO: 10559 - DNA, 23 bp, Artificial Sequence
  Synthetic
ccgttttttttttttgcaactta

SEQ ID NO: 10560 - DNA, 23 bp, Artificial Sequence
  Synthetic
ccgttttttttttttcgccctct

SEQ ID NO: 10561 - DNA, 23 bp, Artificial Sequence
  Synthetic
ccgttttttttttttgttgcagc

SEQ ID NO: 10562 - DNA, 23 bp, Artificial Sequence
  Synthetic
ccgttttttttttttagaggtcg

SEQ ID NO: 10563 - DNA, 23 bp, Artificial Sequence
  Synthetic
ccgttttttttttttccagcagc

SEQ ID NO: 10564 - DNA, 23 bp, Artificial Sequence
  Synthetic
ccgttttttttttttcaccaatg

SEQ ID NO: 10565 - DNA, 23 bp, Artificial Sequence
  Synthetic
ccgttttttttttttacacttac

SEQ ID NO: 10566 - DNA, 23 bp, Artificial Sequence
  Synthetic
ccgttttttttttttactggagg

SEQ ID NO: 10567 - DNA, 23 bp, Artificial Sequence
  Synthetic
ccgttttttttttttacggaagg

SEQ ID NO: 10568 - DNA, 23 bp, Artificial Sequence
  Synthetic
ccgttttttttttttaaaaaggt

SEQ ID NO: 10569 - DNA, 23 bp, Artificial Sequence
  Synthetic
ccgttttttttttttcaatgcaa

SEQ ID NO: 10570 - DNA, 23 bp, Artificial Sequence
  Synthetic
ccgttttttttttttctctgcag

SEQ ID NO: 10571 - DNA, 23 bp, Artificial Sequence
  Synthetic
ccgttttttttttttctaggata

SEQ ID NO: 10572 - DNA, 23 bp, Artificial Sequence
  Synthetic
ccgttttttttttttacattttt

SEQ ID NO: 10573 - DNA, 23 bp, Artificial Sequence
  Synthetic
ccgttttttttttttaaaggcat

SEQ ID NO: 10574 - DNA, 23 bp, Artificial Sequence
  Synthetic
ccgttttttttttttcaacaaaa

SEQ ID NO: 10575 - DNA, 23 bp, Artificial Sequence
  Synthetic
ccgttttttttttttgagctcct

SEQ ID NO: 10576 - DNA, 23 bp, Artificial Sequence
  Synthetic
ccgttttttttttttggctataa

SEQ ID NO: 10577 - DNA, 23 bp, Artificial Sequence
  Synthetic
ccgttttttttttttactgaccg

SEQ ID NO: 10578 - DNA, 23 bp, Artificial Sequence
  Synthetic
ccgttttttttttttgacgggtg

SEQ ID NO: 10579 - DNA, 23 bp, Artificial Sequence
  Synthetic
ccgttttttttttttacagtcag

SEQ ID NO: 10580 - DNA, 23 bp, Artificial Sequence
  Synthetic
ccgttttttttttttgcactgga

SEQ ID NO: 10581 - DNA, 23 bp, Artificial Sequence
  Synthetic
ccgttttttttttttagaggcag

SEQ ID NO: 10582 - DNA, 23 bp, Artificial Sequence
  Synthetic
ccgttttttttttttaacaacca

SEQ ID NO: 10583 - DNA, 23 bp, Artificial Sequence
  Synthetic
ccgttttttttttttcaatcagc

SEQ ID NO: 10584 - DNA, 23 bp, Artificial Sequence
  Synthetic
ccgttttttttttttgcaatcag

SEQ ID NO: 10585 - DNA, 23 bp, Artificial Sequence
  Synthetic
ccgttttttttttttgaaagtgt

SEQ ID NO: 10586 - DNA, 23 bp, Artificial Sequence
  Synthetic
ccgttttttttttttcaggctca

SEQ ID NO: 10587 - DNA, 23 bp, Artificial Sequence
  Synthetic
ccgttttttttttttgtacccct

SEQ ID NO: 10588 - DNA, 23 bp, Artificial Sequence
  Synthetic
ccgttttttttttttcacaccta

SEQ ID NO: 10589 - DNA, 23 bp, Artificial Sequence
  Synthetic
ccgttttttttttttacagatgg

SEQ ID NO: 10590 - DNA, 23 bp, Artificial Sequence
  Synthetic
ccgttttttttttttataaggat

SEQ ID NO: 10591 - DNA, 23 bp, Artificial Sequence
  Synthetic
ccgttttttttttttcaccattg

SEQ ID NO: 10592 - DNA, 23 bp, Artificial Sequence
  Synthetic
ccgttttttttttttaagatcaa

SEQ ID NO: 10593 - DNA, 23 bp, Artificial Sequence
  Synthetic
ccgttttttttttttcgaatata

SEQ ID NO: 10594 - DNA, 23 bp, Artificial Sequence
  Synthetic
ccgttttttttttttaaccaggt

SEQ ID NO: 10595 - DNA, 23 bp, Artificial Sequence
  Synthetic
ccgttttttttttttctcggaca

SEQ ID NO: 10596 - DNA, 23 bp, Artificial Sequence
  Synthetic
ccgttttttttttttcacttagc

SEQ ID NO: 10597 - DNA, 23 bp, Artificial Sequence
  Synthetic
ccgttttttttttttcacgcgag

SEQ ID NO: 10598 - DNA, 23 bp, Artificial Sequence
  Synthetic
ccgttttttttttttacgtggat

SEQ ID NO: 10599 - DNA, 23 bp, Artificial Sequence
  Synthetic
ccgttttttttttttctcataga

SEQ ID NO: 10600 - DNA, 23 bp, Artificial Sequence
  Synthetic
ccgttttttttttttaaagtgga

SEQ ID NO: 10601 - DNA, 23 bp, Artificial Sequence
  Synthetic
ccgttttttttttttaaccatag

SEQ ID NO: 10602 - DNA, 23 bp, Artificial Sequence
  Synthetic
ccgttttttttttttcgtgaaat

SEQ ID NO: 10603 - DNA, 23 bp, Artificial Sequence
  Synthetic
ccgttttttttttttacaaaagt

SEQ ID NO: 10604 - DNA, 23 bp, Artificial Sequence
  Synthetic
ccgttttttttttttacacagga

SEQ ID NO: 10605 - DNA, 23 bp, Artificial Sequence
  Synthetic
ccgttttttttttttcctacgtt

SEQ ID NO: 10606 - DNA, 23 bp, Artificial Sequence
  Synthetic
ccgttttttttttttaagatgtg

SEQ ID NO: 10607 - DNA, 23 bp, Artificial Sequence
  Synthetic
ccgttttttttttttgcgcatgt

SEQ ID NO: 10608 - DNA, 23 bp, Artificial Sequence
  Synthetic
ccgttttttttttttacagagag

SEQ ID NO: 10609 - DNA, 23 bp, Artificial Sequence
  Synthetic
ccgttttttttttttcgaatcca

SEQ ID NO: 10610 - DNA, 23 bp, Artificial Sequence
  Synthetic
ccgttttttttttttagccacag

SEQ ID NO: 10611 - DNA, 23 bp, Artificial Sequence
  Synthetic
ccgttttttttttttgtgaacaa

SEQ ID NO: 10612 - DNA, 23 bp, Artificial Sequence
  Synthetic
ccgttttttttttttaaggggtt

SEQ ID NO: 10613 - DNA, 23 bp, Artificial Sequence
  Synthetic
ccgttttttttttttaacaggcc

SEQ ID NO: 10614 - DNA, 23 bp, Artificial Sequence
  Synthetic
ccgttttttttttttactgaggg

SEQ ID NO: 10615 - DNA, 23 bp, Artificial Sequence
  Synthetic
ccgttttttttttttacggctag

SEQ ID NO: 10616 - DNA, 23 bp, Artificial Sequence
  Synthetic
ccgttttttttttttggccttct

SEQ ID NO: 10617 - DNA, 23 bp, Artificial Sequence
  Synthetic
ccgttttttttttttctgagggg

SEQ ID NO: 10618 - DNA, 23 bp, Artificial Sequence
  Synthetic
ccgttttttttttttccaaaaca

SEQ ID NO: 10619 - DNA, 23 bp, Artificial Sequence
  Synthetic
ccgttttttttttttggcggaca

SEQ ID NO: 10620 - DNA, 23 bp, Artificial Sequence
  Synthetic
ccgttttttttttttacggcatt

SEQ ID NO: 10621 - DNA, 23 bp, Artificial Sequence
  Synthetic
ccgttttttttttttcctgcatg

SEQ ID NO: 10622 - DNA, 23 bp, Artificial Sequence
  Synthetic
ccgttttttttttttacaccgag

SEQ ID NO: 10623 - DNA, 23 bp, Artificial Sequence
  Synthetic
ccgttttttttttttgaataatg

SEQ ID NO: 10624 - DNA, 23 bp, Artificial Sequence
  Synthetic
ccgttttttttttttggagtcga

SEQ ID NO: 10625 - DNA, 23 bp, Artificial Sequence
  Synthetic
ccgttttttttttttggttcaaa

SEQ ID NO: 10626 - DNA, 23 bp, Artificial Sequence
  Synthetic
ccgttttttttttttatgggaca

SEQ ID NO: 10627 - DNA, 23 bp, Artificial Sequence
  Synthetic
ccgttttttttttttaccagcta

SEQ ID NO: 10628 - DNA, 23 bp, Artificial Sequence
  Synthetic
ccgttttttttttttccagctag

SEQ ID NO: 10629 - DNA, 23 bp, Artificial Sequence
  Synthetic
ccgttttttttttttattaggaa

SEQ ID NO: 10630 - DNA, 23 bp, Artificial Sequence
  Synthetic
ccgttttttttttttattcagga

SEQ ID NO: 10631 - DNA, 23 bp, Artificial Sequence
  Synthetic
ccgttttttttttttatgcatgc

SEQ ID NO: 10632 - DNA, 23 bp, Artificial Sequence
  Synthetic
ccgttttttttttttaactcagt

SEQ ID NO: 10633 - DNA, 23 bp, Artificial Sequence
  Synthetic
ccgttttttttttttgtctcagt

SEQ ID NO: 10634 - DNA, 23 bp, Artificial Sequence
  Synthetic
ccgttttttttttttagtgtata

SEQ ID NO: 10635 - DNA, 23 bp, Artificial Sequence
  Synthetic
ccgttttttttttttcgatgtag

SEQ ID NO: 10636 - DNA, 23 bp, Artificial Sequence
  Synthetic
ccgttttttttttttgatggaca

SEQ ID NO: 10637 - DNA, 23 bp, Artificial Sequence
  Synthetic
ccgttttttttttttatctcaca

SEQ ID NO: 10638 - DNA, 23 bp, Artificial Sequence
  Synthetic
ccgttttttttttttcacatcag

SEQ ID NO: 10639 - DNA, 23 bp, Artificial Sequence
  Synthetic
ccgttttttttttttgtcttatg

SEQ ID NO: 10640 - DNA, 23 bp, Artificial Sequence
  Synthetic
ccgttttttttttttcatataca

SEQ ID NO: 10641 - DNA, 23 bp, Artificial Sequence
  Synthetic
ccgttttttttttttgtgtaggt

SEQ ID NO: 10642 - DNA, 23 bp, Artificial Sequence
  Synthetic
ccgttttttttttttgtgttggt

SEQ ID NO: 10643 - DNA, 23 bp, Artificial Sequence
  Synthetic
ccgttttttttttttcagacaca

SEQ ID NO: 10644 - DNA, 23 bp, Artificial Sequence
  Synthetic
ccgttttttttttttggacacca

SEQ ID NO: 10645 - DNA, 23 bp, Artificial Sequence
  Synthetic
ccgttttttttttttcaccagtg

SEQ ID NO: 10646 - DNA, 23 bp, Artificial Sequence
  Synthetic
ccgttttttttttttgtgaaaag

SEQ ID NO: 10647 - DNA, 23 bp, Artificial Sequence
  Synthetic
ccgttttttttttttacaagacg

SEQ ID NO: 10648 - DNA, 23 bp, Artificial Sequence
  Synthetic
ccgttttttttttttatcgggag

SEQ ID NO: 10649 - DNA, 23 bp, Artificial Sequence
  Synthetic
ccgttttttttttttgagaggag

SEQ ID NO: 10650 - DNA, 23 bp, Artificial Sequence
  Synthetic
ccgttttttttttttgaattcat

SEQ ID NO: 10651 - DNA, 23 bp, Artificial Sequence
  Synthetic
ccgttttttttttttctcggggc

SEQ ID NO: 10652 - DNA, 23 bp, Artificial Sequence
  Synthetic
ccgttttttttttttagtggatg

SEQ ID NO: 10653 - DNA, 23 bp, Artificial Sequence
  Synthetic
ccgttttttttttttgagagtgc

SEQ ID NO: 10654 - DNA, 23 bp, Artificial Sequence
  Synthetic
ccgttttttttttttgaccaaga

SEQ ID NO: 10655 - DNA, 23 bp, Artificial Sequence
  Synthetic
ccgttttttttttttgctgccat

SEQ ID NO: 10656 - DNA, 23 bp, Artificial Sequence
  Synthetic
ccgttttttttttttcagcatgg

SEQ ID NO: 10657 - DNA, 23 bp, Artificial Sequence
  Synthetic
ccgttttttttttttcctcatgg

SEQ ID NO: 10658 - DNA, 23 bp, Artificial Sequence
  Synthetic
ccgttttttttttttaggtttcc

SEQ ID NO: 10659 - DNA, 23 bp, Artificial Sequence
  Synthetic
ccgttttttttttttaagaagtg

SEQ ID NO: 10660 - DNA, 23 bp, Artificial Sequence
  Synthetic
ccgttttttttttttgagattgg

SEQ ID NO: 10661 - DNA, 23 bp, Artificial Sequence
  Synthetic
ccgttttttttttttacaaacca

SEQ ID NO: 10662 - DNA, 23 bp, Artificial Sequence
  Synthetic
ccgttttttttttttaaacatca

SEQ ID NO: 10663 - DNA, 23 bp, Artificial Sequence
  Synthetic
ccgttttttttttttctgaaccc

SEQ ID NO: 10664 - DNA, 23 bp, Artificial Sequence
  Synthetic
ccgttttttttttttcacccagg

SEQ ID NO: 10665 - DNA, 23 bp, Artificial Sequence
  Synthetic
ccgttttttttttttcaaatcct

SEQ ID NO: 10666 - DNA, 23 bp, Artificial Sequence
  Synthetic
ccgttttttttttttgcagtact

SEQ ID NO: 10667 - DNA, 23 bp, Artificial Sequence
  Synthetic
ccgttttttttttttagaaaacc

SEQ ID NO: 10668 - DNA, 23 bp, Artificial Sequence
  Synthetic
ccgttttttttttttacggtcct

SEQ ID NO: 10669 - DNA, 23 bp, Artificial Sequence
  Synthetic
ccgttttttttttttacacacca

SEQ ID NO: 10670 - DNA, 23 bp, Artificial Sequence
  Synthetic
ccgttttttttttttccaggatc

SEQ ID NO: 10671 - DNA, 23 bp, Artificial Sequence
  Synthetic
ccgttttttttttttgtgaccaa

SEQ ID NO: 10672 - DNA, 23 bp, Artificial Sequence
  Synthetic
ccgttttttttttttcagttatc

SEQ ID NO: 10673 - DNA, 23 bp, Artificial Sequence
  Synthetic
ccgttttttttttttcgtgacat

SEQ ID NO: 10674 - DNA, 23 bp, Artificial Sequence
  Synthetic
ccgttttttttttttagaagtgc

SEQ ID NO: 10675 - DNA, 23 bp, Artificial Sequence
  Synthetic
ccgttttttttttttgactccgt

SEQ ID NO: 10676 - DNA, 23 bp, Artificial Sequence
  Synthetic
ccgttttttttttttcactcaaa

SEQ ID NO: 10677 - DNA, 23 bp, Artificial Sequence
  Synthetic
ccgttttttttttttcactgaaa

SEQ ID NO: 10678 - DNA, 23 bp, Artificial Sequence
  Synthetic
ccgttttttttttttacatcatc

SEQ ID NO: 10679 - DNA, 23 bp, Artificial Sequence
  Synthetic
ccgttttttttttttaagaggga

SEQ ID NO: 10680 - DNA, 23 bp, Artificial Sequence
  Synthetic
ccgttttttttttttgcacaacc

SEQ ID NO: 10681 - DNA, 23 bp, Artificial Sequence
  Synthetic
ccgttttttttttttaagggacc

SEQ ID NO: 10682 - DNA, 23 bp, Artificial Sequence
  Synthetic
ccgttttttttttttggctctca

SEQ ID NO: 10683 - DNA, 23 bp, Artificial Sequence
  Synthetic
ccgttttttttttttcttgggct

SEQ ID NO: 10684 - DNA, 23 bp, Artificial Sequence
  Synthetic
ccgttttttttttttggtagtgg

SEQ ID NO: 10685 - DNA, 23 bp, Artificial Sequence
  Synthetic
ccgttttttttttttacatgaac

SEQ ID NO: 10686 - DNA, 23 bp, Artificial Sequence
  Synthetic
ccgttttttttttttacatgcac

SEQ ID NO: 10687 - DNA, 23 bp, Artificial Sequence
  Synthetic
ccgttttttttttttacacacat

SEQ ID NO: 10688 - DNA, 23 bp, Artificial Sequence
  Synthetic
ccgttttttttttttcaccacat

SEQ ID NO: 10689 - DNA, 23 bp, Artificial Sequence
  Synthetic
ccgttttttttttttcctccagc

SEQ ID NO: 10690 - DNA, 23 bp, Artificial Sequence
  Synthetic
ccgttttttttttttcacacaca

SEQ ID NO: 10691 - DNA, 23 bp, Artificial Sequence
  Synthetic
ccgttttttttttttctccaagg

SEQ ID NO: 10692 - DNA, 23 bp, Artificial Sequence
  Synthetic
ccgttttttttttttacaccact

SEQ ID NO: 10693 - DNA, 23 bp, Artificial Sequence
  Synthetic
ccgttttttttttttgttctgag

SEQ ID NO: 10694 - DNA, 23 bp, Artificial Sequence
  Synthetic
ccgttttttttttttactgagcg

SEQ ID NO: 10695 - DNA, 23 bp, Artificial Sequence
  Synthetic
ccgttttttttttttactgtggg

SEQ ID NO: 10696 - DNA, 23 bp, Artificial Sequence
  Synthetic
ccgttttttttttttagctcaac

SEQ ID NO: 10697 - DNA, 23 bp, Artificial Sequence
  Synthetic
ccgttttttttttttgcaagtcc

SEQ ID NO: 10698 - DNA, 23 bp, Artificial Sequence
  Synthetic
ccgttttttttttttcagaagct

SEQ ID NO: 10699 - DNA, 23 bp, Artificial Sequence
  Synthetic
ccgttttttttttttcctccagt

SEQ ID NO: 10700 - DNA, 23 bp, Artificial Sequence
  Synthetic
ccgttttttttttttaccaagag

SEQ ID NO: 10701 - DNA, 23 bp, Artificial Sequence
  Synthetic
ccgttttttttttttcccccatg

SEQ ID NO: 10702 - DNA, 23 bp, Artificial Sequence
  Synthetic
ccgttttttttttttagctgcct

SEQ ID NO: 10703 - DNA, 23 bp, Artificial Sequence
  Synthetic
ccgttttttttttttcagacttc

SEQ ID NO: 10704 - DNA, 23 bp, Artificial Sequence
  Synthetic
ccgttttttttttttgaggacac

SEQ ID NO: 10705 - DNA, 23 bp, Artificial Sequence
  Synthetic
ccgttttttttttttgacttgaa

SEQ ID NO: 10706 - DNA, 23 bp, Artificial Sequence
  Synthetic
ccgttttttttttttgtgcctca

SEQ ID NO: 10707 - DNA, 23 bp, Artificial Sequence
  Synthetic
ccgttttttttttttcttcaccg

SEQ ID NO: 10708 - DNA, 23 bp, Artificial Sequence
  Synthetic
ccgttttttttttttcattgctg

SEQ ID NO: 10709 - DNA, 23 bp, Artificial Sequence
  Synthetic
ccgttttttttttttgaataagt

SEQ ID NO: 10710 - DNA, 23 bp, Artificial Sequence
  Synthetic
ccgttttttttttttggaccccg

SEQ ID NO: 10711 - DNA, 23 bp, Artificial Sequence
  Synthetic
ccgttttttttttttggttgtga

SEQ ID NO: 10712 - DNA, 23 bp, Artificial Sequence
  Synthetic
ccgttttttttttttctgcctct

SEQ ID NO: 10713 - DNA, 23 bp, Artificial Sequence
  Synthetic
ccgttttttttttttgagtgagg

SEQ ID NO: 10714 - DNA, 23 bp, Artificial Sequence
  Synthetic
ccgttttttttttttacagccac

SEQ ID NO: 10715 - DNA, 23 bp, Artificial Sequence
  Synthetic
ccgttttttttttttgaaaactt

SEQ ID NO: 10716 - DNA, 23 bp, Artificial Sequence
  Synthetic
ccgttttttttttttcttcaggc

SEQ ID NO: 10717 - DNA, 23 bp, Artificial Sequence
  Synthetic
ccgttttttttttttcagtcacc

SEQ ID NO: 10718 - DNA, 23 bp, Artificial Sequence
  Synthetic
ccgttttttttttttcccacagc

SEQ ID NO: 10719 - DNA, 23 bp, Artificial Sequence
  Synthetic
ccgttttttttttttctccacag

SEQ ID NO: 10720 - DNA, 23 bp, Artificial Sequence
  Synthetic
ccgttttttttttttagggaagg

SEQ ID NO: 10721 - DNA, 23 bp, Artificial Sequence
  Synthetic
ccgttttttttttttcgagccag

SEQ ID NO: 10722 - DNA, 23 bp, Artificial Sequence
  Synthetic
ccgttttttttttttcaacaaaa

SEQ ID NO: 10723 - DNA, 23 bp, Artificial Sequence
  Synthetic
ccgttttttttttttggtggact

SEQ ID NO: 10724 - DNA, 23 bp, Artificial Sequence
  Synthetic
ccgttttttttttttccatctat

SEQ ID NO: 10725 - DNA, 23 bp, Artificial Sequence
  Synthetic
ccgttttttttttttgagcgggg

SEQ ID NO: 10726 - DNA, 23 bp, Artificial Sequence
  Synthetic
ccgttttttttttttctttcctt

SEQ ID NO: 10727 - DNA, 23 bp, Artificial Sequence
  Synthetic
ccgttttttttttttctaggagc

SEQ ID NO: 10728 - DNA, 23 bp, Artificial Sequence
  Synthetic
ccgttttttttttttgcccaccc

SEQ ID NO: 10729 - DNA, 23 bp, Artificial Sequence
  Synthetic
ccgttttttttttttgagacagg

SEQ ID NO: 10730 - DNA, 23 bp, Artificial Sequence
  Synthetic
ccgttttttttttttcgtaggca

SEQ ID NO: 10731 - DNA, 23 bp, Artificial Sequence
  Synthetic
ccgttttttttttttagaagctc

SEQ ID NO: 10732 - DNA, 23 bp, Artificial Sequence
  Synthetic
ccgttttttttttttcctcctgc

SEQ ID NO: 10733 - DNA, 23 bp, Artificial Sequence
  Synthetic
ccgttttttttttttctcaactc

SEQ ID NO: 10734 - DNA, 23 bp, Artificial Sequence
  Synthetic
ccgttttttttttttcttacatc

SEQ ID NO: 10735 - DNA, 23 bp, Artificial Sequence
  Synthetic
ccgttttttttttttggtaccgc

SEQ ID NO: 10736 - DNA, 23 bp, Artificial Sequence
  Synthetic
ccgttttttttttttcaacaccc

SEQ ID NO: 10737 - DNA, 23 bp, Artificial Sequence
  Synthetic
ccgttttttttttttgctgtgtg

SEQ ID NO: 10738 - DNA, 23 bp, Artificial Sequence
  Synthetic
ccgttttttttttttgcgaccga

SEQ ID NO: 10739 - DNA, 23 bp, Artificial Sequence
  Synthetic
ccgttttttttttttcacgcggg

SEQ ID NO: 10740 - DNA, 23 bp, Artificial Sequence
  Synthetic
ccgttttttttttttagagaagg

SEQ ID NO: 10741 - DNA, 23 bp, Artificial Sequence
  Synthetic
ccgttttttttttttcgacaccc

SEQ ID NO: 10742 - DNA, 23 bp, Artificial Sequence
  Synthetic
ccgttttttttttttaacatttt

SEQ ID NO: 10743 - DNA, 23 bp, Artificial Sequence
  Synthetic
ccgttttttttttttggaggccc

SEQ ID NO: 10744 - DNA, 23 bp, Artificial Sequence
  Synthetic
ccgttttttttttttcccccttt

SEQ ID NO: 10745 - DNA, 23 bp, Artificial Sequence
  Synthetic
ccgttttttttttttgctgttag

SEQ ID NO: 10746 - DNA, 23 bp, Artificial Sequence
  Synthetic
ccgttttttttttttagtggacc

SEQ ID NO: 10747 - DNA, 23 bp, Artificial Sequence
  Synthetic
ccgttttttttttttgtcaaaat

SEQ ID NO: 10748 - DNA, 23 bp, Artificial Sequence
  Synthetic
ccgttttttttttttctccccac

SEQ ID NO: 10749 - DNA, 23 bp, Artificial Sequence
  Synthetic
ccgttttttttttttgtgtcagt

SEQ ID NO: 10750 - DNA, 23 bp, Artificial Sequence
  Synthetic
ccgttttttttttttgctctgtc

SEQ ID NO: 10751 - DNA, 23 bp, Artificial Sequence
  Synthetic
ccgttttttttttttgccactgg

SEQ ID NO: 10752 - DNA, 23 bp, Artificial Sequence
  Synthetic
ccgttttttttttttacagttgc

SEQ ID NO: 10753 - DNA, 23 bp, Artificial Sequence
  Synthetic
ccgttttttttttttaggaggac

SEQ ID NO: 10754 - DNA, 23 bp, Artificial Sequence
  Synthetic
ccgttttttttttttccagctcc

SEQ ID NO: 10755 - DNA, 23 bp, Artificial Sequence
  Synthetic
ccgttttttttttttaacaaaat

SEQ ID NO: 10756 - DNA, 23 bp, Artificial Sequence
  Synthetic
ccgttttttttttttgtcgattc

SEQ ID NO: 10757 - DNA, 23 bp, Artificial Sequence
  Synthetic
ccgttttttttttttaaggatga

SEQ ID NO: 10758 - DNA, 23 bp, Artificial Sequence
  Synthetic
ccgttttttttttttccaggtga

SEQ ID NO: 10759 - DNA, 23 bp, Artificial Sequence
  Synthetic
ccgttttttttttttccctatgt

SEQ ID NO: 10760 - DNA, 23 bp, Artificial Sequence
  Synthetic
ccgttttttttttttcatacagc

SEQ ID NO: 10761 - DNA, 23 bp, Artificial Sequence
  Synthetic
ccgttttttttttttactttcgg

SEQ ID NO: 10762 - DNA, 23 bp, Artificial Sequence
  Synthetic
ccgttttttttttttcaggccgg

SEQ ID NO: 10763 - DNA, 23 bp, Artificial Sequence
  Synthetic
ccgttttttttttttctacctgc

SEQ ID NO: 10764 - DNA, 23 bp, Artificial Sequence
  Synthetic
ccgttttttttttttagcaaaaa

SEQ ID NO: 10765 - DNA, 23 bp, Artificial Sequence
  Synthetic
ccgttttttttttttaacaatac

SEQ ID NO: 10766 - DNA, 23 bp, Artificial Sequence
  Synthetic
ccgttttttttttttacaagatc

SEQ ID NO: 10767 - DNA, 23 bp, Artificial Sequence
  Synthetic
ccgttttttttttttcgcaaggt

SEQ ID NO: 10768 - DNA, 23 bp, Artificial Sequence
  Synthetic
ccgttttttttttttcttcagtt

SEQ ID NO: 10769 - DNA, 23 bp, Artificial Sequence
  Synthetic
ccgttttttttttttcatagccc

SEQ ID NO: 10770 - DNA, 23 bp, Artificial Sequence
  Synthetic
ccgttttttttttttacaggagt

SEQ ID NO: 10771 - DNA, 23 bp, Artificial Sequence
  Synthetic
ccgttttttttttttgctacctg

SEQ ID NO: 10772 - DNA, 23 bp, Artificial Sequence
  Synthetic
ccgttttttttttttatctgcac

SEQ ID NO: 10773 - DNA, 23 bp, Artificial Sequence
  Synthetic
ccgttttttttttttgatagccc

SEQ ID NO: 10774 - DNA, 23 bp, Artificial Sequence
  Synthetic
ccgttttttttttttacaaattc

SEQ ID NO: 10775 - DNA, 23 bp, Artificial Sequence
  Synthetic
ccgttttttttttttcacaagtt

SEQ ID NO: 10776 - DNA, 23 bp, Artificial Sequence
  Synthetic
ccgttttttttttttagccaagc

SEQ ID NO: 10777 - DNA, 23 bp, Artificial Sequence
  Synthetic
ccgttttttttttttgccctttt

SEQ ID NO: 10778 - DNA, 23 bp, Artificial Sequence
  Synthetic
ccgttttttttttttacagctgg

SEQ ID NO: 10779 - DNA, 23 bp, Artificial Sequence
  Synthetic
ccgttttttttttttccctctgg

SEQ ID NO: 10780 - DNA, 23 bp, Artificial Sequence
  Synthetic
ccgttttttttttttctaccata

SEQ ID NO: 10781 - DNA, 23 bp, Artificial Sequence
  Synthetic
ccgttttttttttttctagtaca

SEQ ID NO: 10782 - DNA, 23 bp, Artificial Sequence
  Synthetic
ccgttttttttttttaagggatt

SEQ ID NO: 10783 - DNA, 23 bp, Artificial Sequence
  Synthetic
ccgttttttttttttgcagaagc

SEQ ID NO: 10784 - DNA, 23 bp, Artificial Sequence
  Synthetic
ccgttttttttttttcacttttg

SEQ ID NO: 10785 - DNA, 23 bp, Artificial Sequence
  Synthetic
ccgttttttttttttcgaaggca

SEQ ID NO: 10786 - DNA, 23 bp, Artificial Sequence
  Synthetic
ccgttttttttttttcacaaacc

SEQ ID NO: 10787 - DNA, 23 bp, Artificial Sequence
  Synthetic
ccgttttttttttttgtaaacca

SEQ ID NO: 10788 - DNA, 23 bp, Artificial Sequence
  Synthetic
ccgttttttttttttcgccaata

SEQ ID NO: 10789 - DNA, 23 bp, Artificial Sequence
  Synthetic
ccgttttttttttttacaagtgc

SEQ ID NO: 10790 - DNA, 23 bp, Artificial Sequence
  Synthetic
ccgttttttttttttactacctg

SEQ ID NO: 10791 - DNA, 23 bp, Artificial Sequence
  Synthetic
ccgttttttttttttatctgcac

SEQ ID NO: 10792 - DNA, 23 bp, Artificial Sequence
  Synthetic
ccgttttttttttttactcaccg

SEQ ID NO: 10793 - DNA, 23 bp, Artificial Sequence
  Synthetic
ccgttttttttttttggtacaat

SEQ ID NO: 10794 - DNA, 23 bp, Artificial Sequence
  Synthetic
ccgttttttttttttaacccacc

SEQ ID NO: 10795 - DNA, 23 bp, Artificial Sequence
  Synthetic
ccgttttttttttttcagtgaat

SEQ ID NO: 10796 - DNA, 23 bp, Artificial Sequence
  Synthetic
ccgttttttttttttacccttat

SEQ ID NO: 10797 - DNA, 23 bp, Artificial Sequence
  Synthetic
ccgttttttttttttcggctgca

SEQ ID NO: 10798 - DNA, 23 bp, Artificial Sequence
  Synthetic
ccgttttttttttttaccctcca

SEQ ID NO: 10799 - DNA, 23 bp, Artificial Sequence
  Synthetic
ccgttttttttttttactgatat

SEQ ID NO: 10800 - DNA, 23 bp, Artificial Sequence
  Synthetic
ccgttttttttttttccacatgg

SEQ ID NO: 10801 - DNA, 23 bp, Artificial Sequence
  Synthetic
ccgttttttttttttgccgggtg

SEQ ID NO: 10802 - DNA, 23 bp, Artificial Sequence
  Synthetic
ccgttttttttttttcctatttc

SEQ ID NO: 10803 - DNA, 23 bp, Artificial Sequence
  Synthetic
ccgttttttttttttgaacaggt

SEQ ID NO: 10804 - DNA, 23 bp, Artificial Sequence
  Synthetic
ccgttttttttttttcagttttg

SEQ ID NO: 10805 - DNA, 23 bp, Artificial Sequence
  Synthetic
ccgttttttttttttcagttttg

SEQ ID NO: 10806 - DNA, 23 bp, Artificial Sequence
  Synthetic
ccgttttttttttttacctgcac

SEQ ID NO: 10807 - DNA, 23 bp, Artificial Sequence
  Synthetic
ccgttttttttttttaggcatag

SEQ ID NO: 10808 - DNA, 23 bp, Artificial Sequence
  Synthetic
ccgttttttttttttcagactcc

SEQ ID NO: 10809 - DNA, 23 bp, Artificial Sequence
  Synthetic
ccgttttttttttttccacacac

SEQ ID NO: 10810 - DNA, 23 bp, Artificial Sequence
  Synthetic
ccgttttttttttttcaacatca

SEQ ID NO: 10811 - DNA, 23 bp, Artificial Sequence
  Synthetic
ccgttttttttttttaggcgaag

SEQ ID NO: 10812 - DNA, 23 bp, Artificial Sequence
  Synthetic
ccgttttttttttttctgcctgt

SEQ ID NO: 10813 - DNA, 23 bp, Artificial Sequence
  Synthetic
ccgttttttttttttgtctgtca

SEQ ID NO: 10814 - DNA, 23 bp, Artificial Sequence
  Synthetic
ccgttttttttttttacatggtt

SEQ ID NO: 10815 - DNA, 23 bp, Artificial Sequence
  Synthetic
ccgttttttttttttacagttct

SEQ ID NO: 10816 - DNA, 23 bp, Artificial Sequence
  Synthetic
ccgttttttttttttaaagtgtc

SEQ ID NO: 10817 - DNA, 23 bp, Artificial Sequence
  Synthetic
ccgttttttttttttaaacggaa

SEQ ID NO: 10818 - DNA, 23 bp, Artificial Sequence
  Synthetic
ccgttttttttttttggaaatcc

SEQ ID NO: 10819 - DNA, 23 bp, Artificial Sequence
  Synthetic
ccgttttttttttttctgttcct

SEQ ID NO: 10820 - DNA, 23 bp, Artificial Sequence
  Synthetic
ccgttttttttttttcagaccga

SEQ ID NO: 10821 - DNA, 23 bp, Artificial Sequence
  Synthetic
ccgttttttttttttagcctatc

SEQ ID NO: 10822 - DNA, 23 bp, Artificial Sequence
  Synthetic
ccgttttttttttttggcggaac

SEQ ID NO: 10823 - DNA, 23 bp, Artificial Sequence
  Synthetic
ccgttttttttttttctcaatag

SEQ ID NO: 10824 - DNA, 23 bp, Artificial Sequence
  Synthetic
ccgttttttttttttaaccgatt

SEQ ID NO: 10825 - DNA, 23 bp, Artificial Sequence
  Synthetic
ccgttttttttttttactgattt

SEQ ID NO: 10826 - DNA, 23 bp, Artificial Sequence
  Synthetic
ccgttttttttttttgctgagtg

SEQ ID NO: 10827 - DNA, 23 bp, Artificial Sequence
  Synthetic
ccgttttttttttttgctgagag

SEQ ID NO: 10828 - DNA, 23 bp, Artificial Sequence
  Synthetic
ccgttttttttttttcttccagt

SEQ ID NO: 10829 - DNA, 23 bp, Artificial Sequence
  Synthetic
ccgttttttttttttcagctatg

SEQ ID NO: 10830 - DNA, 23 bp, Artificial Sequence
  Synthetic
ccgttttttttttttgcaactta

SEQ ID NO: 10831 - DNA, 23 bp, Artificial Sequence
  Synthetic
ccgttttttttttttcaatgcaa

SEQ ID NO: 10832 - DNA, 23 bp, Artificial Sequence
  Synthetic
ccgttttttttttttacaaccag

SEQ ID NO: 10833 - DNA, 23 bp, Artificial Sequence
  Synthetic
ccgttttttttttttaacaaaat

SEQ ID NO: 10834 - DNA, 23 bp, Artificial Sequence
  Synthetic
ccgttttttttttttcatacagc

SEQ ID NO: 10835 - DNA, 23 bp, Artificial Sequence
  Synthetic
ccgttttttttttttacaggccg

SEQ ID NO: 10836 - DNA, 23 bp, Artificial Sequence
  Synthetic
ccgttttttttttttctacctgc

SEQ ID NO: 10837 - DNA, 23 bp, Artificial Sequence
  Synthetic
ccgttttttttttttgcaaaaat

SEQ ID NO: 10838 - DNA, 23 bp, Artificial Sequence
  Synthetic
ccgttttttttttttcacaagat

SEQ ID NO: 10839 - DNA, 23 bp, Artificial Sequence
  Synthetic
ccgttttttttttttgtgctctc

SEQ ID NO: 10840 - DNA, 23 bp, Artificial Sequence
  Synthetic
ccgttttttttttttggcataca

SEQ ID NO: 10841 - DNA, 23 bp, Artificial Sequence
  Synthetic
ccgttttttttttttctggatgc

SEQ ID NO: 10842 - DNA, 23 bp, Artificial Sequence
  Synthetic
ccgttttttttttttggggaatg

SEQ ID NO: 10843 - DNA, 23 bp, Artificial Sequence
  Synthetic
ccgttttttttttttcggcaagt

SEQ ID NO: 10844 - DNA, 23 bp, Artificial Sequence
  Synthetic
ccgttttttttttttcggcaagt

SEQ ID NO: 10845 - DNA, 23 bp, Artificial Sequence
  Synthetic
ccgttttttttttttgatattgg

SEQ ID NO: 10846 - DNA, 23 bp, Artificial Sequence
  Synthetic
ccgttttttttttttgggagctc

SEQ ID NO: 10847 - DNA, 23 bp, Artificial Sequence
  Synthetic
ccgttttttttttttgatcaatg

SEQ ID NO: 10848 - DNA, 23 bp, Artificial Sequence
  Synthetic
ccgttttttttttttgagttccc

SEQ ID NO: 10849 - DNA, 23 bp, Artificial Sequence
  Synthetic
ccgttttttttttttgagttccc

SEQ ID NO: 10850 - DNA, 23 bp, Artificial Sequence
  Synthetic
ccgttttttttttttgagttccc

SEQ ID NO: 10851 - DNA, 23 bp, Artificial Sequence
  Synthetic
ccgttttttttttttgagttccc

SEQ ID NO: 10852 - DNA, 23 bp, Artificial Sequence
  Synthetic
ccgttttttttttttgagttccc

SEQ ID NO: 10853 - DNA, 23 bp, Artificial Sequence
  Synthetic
ccgttttttttttttgagttccc

SEQ ID NO: 10854 - DNA, 23 bp, Artificial Sequence
  Synthetic
ccgttttttttttttgagttccc

SEQ ID NO: 10855 - DNA, 23 bp, Artificial Sequence
  Synthetic
ccgttttttttttttaagttccc

SEQ ID NO: 10856 - DNA, 23 bp, Artificial Sequence
  Synthetic
ccgttttttttttttgagttccc

SEQ ID NO: 10857 - DNA, 23 bp, Artificial Sequence
  Synthetic
ccgttttttttttttgagttccc

SEQ ID NO: 10858 - DNA, 23 bp, Artificial Sequence
  Synthetic
ccgttttttttttttgagttccc

SEQ ID NO: 10859 - DNA, 23 bp, Artificial Sequence
  Synthetic
ccgttttttttttttgagttccc

SEQ ID NO: 10860 - DNA, 23 bp, Artificial Sequence
  Synthetic
ccgttttttttttttgagttccc

SEQ ID NO: 10861 - DNA, 23 bp, Artificial Sequence
  Synthetic
ccgttttttttttttgagttccc

SEQ ID NO: 10862 - DNA, 23 bp, Artificial Sequence
  Synthetic
ccgttttttttttttgagttccc

SEQ ID NO: 10863 - DNA, 23 bp, Artificial Sequence
  Synthetic
ccgttttttttttttgagttccc

SEQ ID NO: 10864 - DNA, 23 bp, Artificial Sequence
  Synthetic
ccgttttttttttttctgggcaa

SEQ ID NO: 10865 - DNA, 23 bp, Artificial Sequence
  Synthetic
ccgttttttttttttcagggcag

SEQ ID NO: 10866 - DNA, 23 bp, Artificial Sequence
  Synthetic
ccgttttttttttttcagggcaa

SEQ ID NO: 10867 - DNA, 23 bp, Artificial Sequence
  Synthetic
ccgttttttttttttagggcagc

SEQ ID NO: 10868 - DNA, 23 bp, Artificial Sequence
  Synthetic
ccgttttttttttttctgggcaa

SEQ ID NO: 10869 - DNA, 23 bp, Artificial Sequence
  Synthetic
ccgttttttttttttagccaagc

SEQ ID NO: 10870 - DNA, 23 bp, Artificial Sequence
  Synthetic
ccgttttttttttttccatcatc

SEQ ID NO: 10871 - DNA, 23 bp, Artificial Sequence
  Synthetic
ccgttttttttttttcctgcatg

SEQ ID NO: 10872 - DNA, 23 bp, Artificial Sequence
  Synthetic
ccgttttttttttttccacccaa

SEQ ID NO: 10873 - DNA, 23 bp, Artificial Sequence
  Synthetic
ccgttttttttttttgtgctcac

SEQ ID NO: 10874 - DNA, 23 bp, Artificial Sequence
  Synthetic
ccgttttttttttttgtgctcac

SEQ ID NO: 10875 - DNA, 23 bp, Artificial Sequence
  Synthetic
ccgttttttttttttgtgctcac

SEQ ID NO: 10876 - DNA, 23 bp, Artificial Sequence
  Synthetic
ccgttttttttttttgtgctcac

SEQ ID NO: 10877 - DNA, 23 bp, Artificial Sequence
  Synthetic
ccgttttttttttttgtgctcac

SEQ ID NO: 10878 - DNA, 23 bp, Artificial Sequence
  Synthetic
ccgttttttttttttgtgctcac

SEQ ID NO: 10879 - DNA, 23 bp, Artificial Sequence
  Synthetic
ccgttttttttttttgtgctcac

SEQ ID NO: 10880 - DNA, 23 bp, Artificial Sequence
  Synthetic
ccgttttttttttttgtgctcac

SEQ ID NO: 10881 - DNA, 23 bp, Artificial Sequence
  Synthetic
ccgttttttttttttgtgctcac

SEQ ID NO: 10882 - DNA, 23 bp, Artificial Sequence
  Synthetic
ccgttttttttttttgtgctcac

SEQ ID NO: 10883 - DNA, 23 bp, Artificial Sequence
  Synthetic
ccgttttttttttttgtgctctc

SEQ ID NO: 10884 - DNA, 23 bp, Artificial Sequence
  Synthetic
ccgttttttttttttatgctcac

SEQ ID NO: 10885 - DNA, 23 bp, Artificial Sequence
  Synthetic
ccgttttttttttttcagagctc

SEQ ID NO: 10886 - DNA, 23 bp, Artificial Sequence
  Synthetic
ccgttttttttttttcagagctc

SEQ ID NO: 10887 - DNA, 23 bp, Artificial Sequence
  Synthetic
ccgttttttttttttggagctcc

SEQ ID NO: 10888 - DNA, 23 bp, Artificial Sequence
  Synthetic
ccgttttttttttttcggagctc

SEQ ID NO: 10889 - DNA, 23 bp, Artificial Sequence
  Synthetic
ccgttttttttttttaggagctc

SEQ ID NO: 10890 - DNA, 23 bp, Artificial Sequence
  Synthetic
ccgttttttttttttagagctcc

SEQ ID NO: 10891 - DNA, 23 bp, Artificial Sequence
  Synthetic
ccgttttttttttttggcataca

SEQ ID NO: 10892 - DNA, 23 bp, Artificial Sequence
  Synthetic
ccgttttttttttttggcataca

SEQ ID NO: 10893 - DNA, 23 bp, Artificial Sequence
  Synthetic
ccgttttttttttttggcataca

SEQ ID NO: 10894 - DNA, 23 bp, Artificial Sequence
  Synthetic
ccgttttttttttttggcataca

SEQ ID NO: 10895 - DNA, 23 bp, Artificial Sequence
  Synthetic
ccgttttttttttttcggcatac

SEQ ID NO: 10896 - DNA, 23 bp, Artificial Sequence
  Synthetic
ccgttttttttttttggcattca

SEQ ID NO: 10897 - DNA, 23 bp, Artificial Sequence
  Synthetic
ccgttttttttttttctggatgc

SEQ ID NO: 10898 - DNA, 23 bp, Artificial Sequence
  Synthetic
ccgttttttttttttctggatgc

SEQ ID NO: 10899 - DNA, 23 bp, Artificial Sequence
  Synthetic
ccgttttttttttttgcacgtgc

SEQ ID NO: 10900 - DNA, 23 bp, Artificial Sequence
  Synthetic
ccgttttttttttttgcacgtgc

SEQ ID NO: 10901 - DNA, 23 bp, Artificial Sequence
  Synthetic
ccgttttttttttttgcacgtac

SEQ ID NO: 10902 - DNA, 23 bp, Artificial Sequence
  Synthetic
ccgttttttttttttagcacgtg

SEQ ID NO: 10903 - DNA, 23 bp, Artificial Sequence
  Synthetic
ccgttttttttttttctcacgtg

SEQ ID NO: 10904 - DNA, 23 bp, Artificial Sequence
  Synthetic
ccgttttttttttttgcacgtgc

SEQ ID NO: 10905 - DNA, 23 bp, Artificial Sequence
  Synthetic
ccgttttttttttttggggaatg

SEQ ID NO: 10906 - DNA, 23 bp, Artificial Sequence
  Synthetic
ccgttttttttttttggggaatg

SEQ ID NO: 10907 - DNA, 23 bp, Artificial Sequence
  Synthetic
ccgttttttttttttggggaatg

SEQ ID NO: 10908 - DNA, 23 bp, Artificial Sequence
  Synthetic
ccgttttttttttttggggaatg

SEQ ID NO: 10909 - DNA, 23 bp, Artificial Sequence
  Synthetic
ccgttttttttttttggggaatg

SEQ ID NO: 10910 - DNA, 23 bp, Artificial Sequence
  Synthetic
ccgttttttttttttggggaatg

SEQ ID NO: 10911 - DNA, 23 bp, Artificial Sequence
  Synthetic
ccgttttttttttttgaggaatg

SEQ ID NO: 10912 - DNA, 23 bp, Artificial Sequence
  Synthetic
ccgttttttttttttgaggaatg

SEQ ID NO: 10913 - DNA, 23 bp, Artificial Sequence
  Synthetic
ccgttttttttttttgaggaatg

SEQ ID NO: 10914 - DNA, 23 bp, Artificial Sequence
  Synthetic
ccgttttttttttttgaggaatg

SEQ ID NO: 10915 - DNA, 23 bp, Artificial Sequence
  Synthetic
ccgttttttttttttagggattg

SEQ ID NO: 10916 - DNA, 23 bp, Artificial Sequence
  Synthetic
ccgttttttttttttagggattg

SEQ ID NO: 10917 - DNA, 23 bp, Artificial Sequence
  Synthetic
ccgttttttttttttagggaatg

SEQ ID NO: 10918 - DNA, 23 bp, Artificial Sequence
  Synthetic
ccgttttttttttttggggaatg

SEQ ID NO: 10919 - DNA, 23 bp, Artificial Sequence
  Synthetic
ccgttttttttttttagatcatg

SEQ ID NO: 10920 - DNA, 23 bp, Artificial Sequence
  Synthetic
ccgttttttttttttagatcatg

SEQ ID NO: 10921 - DNA, 23 bp, Artificial Sequence
  Synthetic
ccgttttttttttttagatcatg

SEQ ID NO: 10922 - DNA, 23 bp, Artificial Sequence
  Synthetic
ccgttttttttttttcagatcat

SEQ ID NO: 10923 - DNA, 23 bp, Artificial Sequence
  Synthetic
ccgttttttttttttcagatcat

SEQ ID NO: 10924 - DNA, 23 bp, Artificial Sequence
  Synthetic
ccgttttttttttttcagatcat

SEQ ID NO: 10925 - DNA, 23 bp, Artificial Sequence
  Synthetic
ccgttttttttttttcagatcat

SEQ ID NO: 10926 - DNA, 23 bp, Artificial Sequence
  Synthetic
ccgttttttttttttcagatcat

SEQ ID NO: 10927 - DNA, 23 bp, Artificial Sequence
  Synthetic
ccgttttttttttttcagatcat

SEQ ID NO: 10928 - DNA, 23 bp, Artificial Sequence
  Synthetic
ccgttttttttttttcagatcat

SEQ ID NO: 10929 - DNA, 23 bp, Artificial Sequence
  Synthetic
ccgttttttttttttgtcccgat

SEQ ID NO: 10930 - DNA, 23 bp, Artificial Sequence
  Synthetic
ccgttttttttttttcccgagct

SEQ ID NO: 10931 - DNA, 23 bp, Artificial Sequence
  Synthetic
ccgttttttttttttcggcaagt

SEQ ID NO: 10932 - DNA, 23 bp, Artificial Sequence
  Synthetic
ccgttttttttttttccggcaag

SEQ ID NO: 10933 - DNA, 23 bp, Artificial Sequence
  Synthetic
ccgttttttttttttccggcaag

SEQ ID NO: 10934 - DNA, 23 bp, Artificial Sequence
  Synthetic
ccgttttttttttttccggcaat

SEQ ID NO: 10935 - DNA, 23 bp, Artificial Sequence
  Synthetic
ccgttttttttttttccggcaag

SEQ ID NO: 10936 - DNA, 23 bp, Artificial Sequence
  Synthetic
ccgttttttttttttaggcaagt

SEQ ID NO: 10937 - DNA, 23 bp, Artificial Sequence
  Synthetic
ccgttttttttttttaggcaagt

SEQ ID NO: 10938 - DNA, 23 bp, Artificial Sequence
  Synthetic
ccgttttttttttttcaggcaag

SEQ ID NO: 10939 - DNA, 23 bp, Artificial Sequence
  Synthetic
ccgttttttttttttcaggcaag

SEQ ID NO: 10940 - DNA, 23 bp, Artificial Sequence
  Synthetic
ccgttttttttttttcaggcaag

SEQ ID NO: 10941 - DNA, 23 bp, Artificial Sequence
  Synthetic
ccgttttttttttttcaggcaag

SEQ ID NO: 10942 - DNA, 23 bp, Artificial Sequence
  Synthetic
ccgttttttttttttcaggcaag

SEQ ID NO: 10943 - DNA, 23 bp, Artificial Sequence
  Synthetic
ccgttttttttttttcaggcaag

SEQ ID NO: 10944 - DNA, 23 bp, Artificial Sequence
  Synthetic
ccgttttttttttttaggcaagt

SEQ ID NO: 10945 - DNA, 23 bp, Artificial Sequence
  Synthetic
ccgttttttttttttaggcaagt

SEQ ID NO: 10946 - DNA, 23 bp, Artificial Sequence
  Synthetic
ccgttttttttttttccggcaag

SEQ ID NO: 10947 - DNA, 23 bp, Artificial Sequence
  Synthetic
ccgttttttttttttcatgggca

SEQ ID NO: 10948 - DNA, 23 bp, Artificial Sequence
  Synthetic
ccgttttttttttttgatattgg

SEQ ID NO: 10949 - DNA, 23 bp, Artificial Sequence
  Synthetic
ccgttttttttttttgatattgg

SEQ ID NO: 10950 - DNA, 23 bp, Artificial Sequence
  Synthetic
ccgttttttttttttgatattgg

SEQ ID NO: 10951 - DNA, 23 bp, Artificial Sequence
  Synthetic
ccgttttttttttttgatattgg

SEQ ID NO: 10952 - DNA, 23 bp, Artificial Sequence
  Synthetic
ccgttttttttttttgatattgg

SEQ ID NO: 10953 - DNA, 23 bp, Artificial Sequence
  Synthetic
ccgttttttttttttgatattgg

SEQ ID NO: 10954 - DNA, 23 bp, Artificial Sequence
  Synthetic
ccgttttttttttttgatattgg

SEQ ID NO: 10955 - DNA, 23 bp, Artificial Sequence
  Synthetic
ccgttttttttttttagtgatat

SEQ ID NO: 10956 - DNA, 23 bp, Artificial Sequence
  Synthetic
ccgttttttttttttgatattga

SEQ ID NO: 10957 - DNA, 23 bp, Artificial Sequence
  Synthetic
ccgttttttttttttatgcagca

SEQ ID NO: 10958 - DNA, 23 bp, Artificial Sequence
  Synthetic
ccgttttttttttttatgcagca

SEQ ID NO: 10959 - DNA, 23 bp, Artificial Sequence
  Synthetic
ccgttttttttttttgtgcagca

SEQ ID NO: 10960 - DNA, 23 bp, Artificial Sequence
  Synthetic
ccgttttttttttttatgcagca

SEQ ID NO: 10961 - DNA, 23 bp, Artificial Sequence
  Synthetic
ccgttttttttttttgggagcac

SEQ ID NO: 10962 - DNA, 23 bp, Artificial Sequence
  Synthetic
ccgttttttttttttgggagcac

SEQ ID NO: 10963 - DNA, 23 bp, Artificial Sequence
  Synthetic
ccgttttttttttttggcgctat

SEQ ID NO: 10964 - DNA, 23 bp, Artificial Sequence
  Synthetic
ccgttttttttttttgatcaatg

SEQ ID NO: 10965 - DNA, 23 bp, Artificial Sequence
  Synthetic
ccgttttttttttttagatcaat

SEQ ID NO: 10966 - DNA, 23 bp, Artificial Sequence
  Synthetic
ccgttttttttttttggaggtgg

SEQ ID NO: 10967 - DNA, 23 bp, Artificial Sequence
  Synthetic
ccgttttttttttttgagttccc

SEQ ID NO: 10968 - DNA, 23 bp, Artificial Sequence
  Synthetic
ccgttttttttttttgagttccc

SEQ ID NO: 10969 - DNA, 23 bp, Artificial Sequence
  Synthetic
ccgttttttttttttgagttcct

SEQ ID NO: 10970 - DNA, 23 bp, Artificial Sequence
  Synthetic
ccgttttttttttttgagttccc

SEQ ID NO: 10971 - DNA, 23 bp, Artificial Sequence
  Synthetic
ccgttttttttttttgagttccc

SEQ ID NO: 10972 - DNA, 23 bp, Artificial Sequence
  Synthetic
ccgttttttttttttgagttccc

SEQ ID NO: 10973 - DNA, 23 bp, Artificial Sequence
  Synthetic
ccgttttttttttttgagttccc

SEQ ID NO: 10974 - DNA, 23 bp, Artificial Sequence
  Synthetic
ccgttttttttttttgagttccc

SEQ ID NO: 10975 - DNA, 23 bp, Artificial Sequence
  Synthetic
ccgttttttttttttgagttccc

SEQ ID NO: 10976 - DNA, 23 bp, Artificial Sequence
  Synthetic
ccgttttttttttttgagttccc

SEQ ID NO: 10977 - DNA, 23 bp, Artificial Sequence
  Synthetic
ccgttttttttttttgagttccc

SEQ ID NO: 10978 - DNA, 23 bp, Artificial Sequence
  Synthetic
ccgttttttttttttgagttccc

SEQ ID NO: 10979 - DNA, 23 bp, Artificial Sequence
  Synthetic
ccgttttttttttttgagttccc

SEQ ID NO: 10980 - DNA, 23 bp, Artificial Sequence
  Synthetic
ccgttttttttttttgagttccc

SEQ ID NO: 10981 - DNA, 23 bp, Artificial Sequence
  Synthetic
ccgttttttttttttgagttcct

SEQ ID NO: 10982 - DNA, 23 bp, Artificial Sequence
  Synthetic
ccgttttttttttttgagttccc

SEQ ID NO: 10983 - DNA, 23 bp, Artificial Sequence
  Synthetic
ccgttttttttttttgagttccc

SEQ ID NO: 10984 - DNA, 23 bp, Artificial Sequence
  Synthetic
ccgttttttttttttgagttccc

SEQ ID NO: 10985 - DNA, 23 bp, Artificial Sequence
  Synthetic
ccgttttttttttttgagttccc

SEQ ID NO: 10986 - DNA, 23 bp, Artificial Sequence
  Synthetic
ccgttttttttttttgagtttcc

SEQ ID NO: 10987 - DNA, 23 bp, Artificial Sequence
  Synthetic
ccgttttttttttttgatttccc

SEQ ID NO: 10988 - DNA, 23 bp, Artificial Sequence
  Synthetic
ccgttttttttttttgagttccg

SEQ ID NO: 10989 - DNA, 23 bp, Artificial Sequence
  Synthetic
ccgttttttttttttgagaatcc

SEQ ID NO: 10990 - DNA, 23 bp, Artificial Sequence
  Synthetic
ccgttttttttttttcagttcaa

SEQ ID NO: 10991 - DNA, 23 bp, Artificial Sequence
  Synthetic
ccgttttttttttttcagttcaa

SEQ ID NO: 10992 - DNA, 23 bp, Artificial Sequence
  Synthetic
ccgttttttttttttaagttcaa

SEQ ID NO: 10993 - DNA, 23 bp, Artificial Sequence
  Synthetic
ccgttttttttttttcagttcaa

SEQ ID NO: 10994 - DNA, 23 bp, Artificial Sequence
  Synthetic
ccgttttttttttttcagttcaa

SEQ ID NO: 10995 - DNA, 23 bp, Artificial Sequence
  Synthetic
ccgttttttttttttcatcaacg

SEQ ID NO: 10996 - DNA, 23 bp, Artificial Sequence
  Synthetic
ccgttttttttttttcatcaacg

SEQ ID NO: 10997 - DNA, 23 bp, Artificial Sequence
  Synthetic
ccgttttttttttttaaggggtg

SEQ ID NO: 10998 - DNA, 23 bp, Artificial Sequence
  Synthetic
ccgttttttttttttcaggggcg

SEQ ID NO: 10999 - DNA, 23 bp, Artificial Sequence
  Synthetic
ccgttttttttttttcagggcaa

SEQ ID NO: 11000 - DNA, 23 bp, Artificial Sequence
  Synthetic
ccgttttttttttttcagggcaa

SEQ ID NO: 11001 - DNA, 23 bp, Artificial Sequence
  Synthetic
ccgttttttttttttcagggcaa

SEQ ID NO: 11002 - DNA, 23 bp, Artificial Sequence
  Synthetic
ccgttttttttttttcagggcaa

SEQ ID NO: 11003 - DNA, 23 bp, Artificial Sequence
  Synthetic
ccgttttttttttttctgggcaa

SEQ ID NO: 11004 - DNA, 23 bp, Artificial Sequence
  Synthetic
ccgttttttttttttctgggcaa

SEQ ID NO: 11005 - DNA, 23 bp, Artificial Sequence
  Synthetic
ccgttttttttttttctgggcaa

SEQ ID NO: 11006 - DNA, 23 bp, Artificial Sequence
  Synthetic
ccgttttttttttttctgggcaa

SEQ ID NO: 11007 - DNA, 23 bp, Artificial Sequence
  Synthetic
ccgttttttttttttcagggcag

SEQ ID NO: 11008 - DNA, 23 bp, Artificial Sequence
  Synthetic
ccgttttttttttttagggcaac

SEQ ID NO: 11009 - DNA, 23 bp, Artificial Sequence
  Synthetic
ccgttttttttttttcggggcaa

SEQ ID NO: 11010 - DNA, 23 bp, Artificial Sequence
  Synthetic
ccgttttttttttttgccaggga

SEQ ID NO: 11011 - DNA, 23 bp, Artificial Sequence
  Synthetic
ccgttttttttttttgtgcagaa

SEQ ID NO: 11012 - DNA, 23 bp, Artificial Sequence
  Synthetic
ccgttttttttttttggacgatg

SEQ ID NO: 11013 - DNA, 23 bp, Artificial Sequence
  Synthetic
ccgttttttttttttctgctctg

SEQ ID NO: 11014 - DNA, 23 bp, Artificial Sequence
  Synthetic
ccgttttttttttttgaacagtg

SEQ ID NO: 11015 - DNA, 23 bp, Artificial Sequence
  Synthetic
ccgttttttttttttggaacaaa

SEQ ID NO: 11016 - DNA, 23 bp, Artificial Sequence
  Synthetic
ccgttttttttttttcgtcattt

SEQ ID NO: 11017 - DNA, 23 bp, Artificial Sequence
  Synthetic
ccgttttttttttttcaacatcg

SEQ ID NO: 11018 - DNA, 23 bp, Artificial Sequence
  Synthetic
ccgttttttttttttatcatttc

SEQ ID NO: 11019 - DNA, 23 bp, Artificial Sequence
  Synthetic
ccgttttttttttttcgtaagga

SEQ ID NO: 11020 - DNA, 23 bp, Artificial Sequence
  Synthetic
ccgttttttttttttcaactcca

SEQ ID NO: 11021 - DNA, 23 bp, Artificial Sequence
  Synthetic
ccgttttttttttttaagtcaaa

SEQ ID NO: 11022 - DNA, 23 bp, Artificial Sequence
  Synthetic
ccgttttttttttttcactataa

SEQ ID NO: 11023 - DNA, 23 bp, Artificial Sequence
  Synthetic
ccgttttttttttttcgaacaac

SEQ ID NO: 11024 - DNA, 23 bp, Artificial Sequence
  Synthetic
ccgttttttttttttcgaacaac

SEQ ID NO: 11025 - DNA, 23 bp, Artificial Sequence
  Synthetic
ccgttttttttttttcgaacaac

SEQ ID NO: 11026 - DNA, 23 bp, Artificial Sequence
  Synthetic
ccgttttttttttttcgaacaac

SEQ ID NO: 11027 - DNA, 23 bp, Artificial Sequence
  Synthetic
ccgttttttttttttcgaacaac

SEQ ID NO: 11028 - DNA, 23 bp, Artificial Sequence
  Synthetic
ccgttttttttttttcgaacaac

SEQ ID NO: 11029 - DNA, 23 bp, Artificial Sequence
  Synthetic
ccgttttttttttttcgaacaac

SEQ ID NO: 11030 - DNA, 23 bp, Artificial Sequence
  Synthetic
ccgttttttttttttcgaacaac

SEQ ID NO: 11031 - DNA, 23 bp, Artificial Sequence
  Synthetic
ccgttttttttttttcgaacaac

SEQ ID NO: 11032 - DNA, 23 bp, Artificial Sequence
  Synthetic
ccgttttttttttttcgaacaac

SEQ ID NO: 11033 - DNA, 23 bp, Artificial Sequence
  Synthetic
ccgttttttttttttgtcccgat

SEQ ID NO: 11034 - DNA, 23 bp, Artificial Sequence
  Synthetic
ccgttttttttttttcccacatt

SEQ ID NO: 11035 - DNA, 23 bp, Artificial Sequence
  Synthetic
ccgttttttttttttcccacatt

SEQ ID NO: 11036 - DNA, 23 bp, Artificial Sequence
  Synthetic
ccgttttttttttttcccacatt

SEQ ID NO: 11037 - DNA, 23 bp, Artificial Sequence
  Synthetic
ccgttttttttttttattcgtct

SEQ ID NO: 11038 - DNA, 23 bp, Artificial Sequence
  Synthetic
ccgttttttttttttccagattt

SEQ ID NO: 11039 - DNA, 23 bp, Artificial Sequence
  Synthetic
ccgttttttttttttgcagcaag

SEQ ID NO: 11040 - DNA, 23 bp, Artificial Sequence
  Synthetic
ccgttttttttttttatcggatg

SEQ ID NO: 11041 - DNA, 23 bp, Artificial Sequence
  Synthetic
ccgttttttttttttatcggatg

SEQ ID NO: 11042 - DNA, 23 bp, Artificial Sequence
  Synthetic
ccgttttttttttttatcggatg

SEQ ID NO: 11043 - DNA, 23 bp, Artificial Sequence
  Synthetic
ccgttttttttttttatcggatg

SEQ ID NO: 11044 - DNA, 23 bp, Artificial Sequence
  Synthetic
ccgttttttttttttatcggatg

SEQ ID NO: 11045 - DNA, 23 bp, Artificial Sequence
  Synthetic
ccgttttttttttttatcggatg

SEQ ID NO: 11046 - DNA, 23 bp, Artificial Sequence
  Synthetic
ccgttttttttttttatcggatg

SEQ ID NO: 11047 - DNA, 23 bp, Artificial Sequence
  Synthetic
ccgttttttttttttatcggatg

SEQ ID NO: 11048 - DNA, 23 bp, Artificial Sequence
  Synthetic
ccgttttttttttttatcggatg

SEQ ID NO: 11049 - DNA, 23 bp, Artificial Sequence
  Synthetic
ccgttttttttttttccatttcc

SEQ ID NO: 11050 - DNA, 23 bp, Artificial Sequence
  Synthetic
ccgttttttttttttctcctctg

SEQ ID NO: 11051 - DNA, 23 bp, Artificial Sequence
  Synthetic
ccgttttttttttttgaagaaga

SEQ ID NO: 11052 - DNA, 23 bp, Artificial Sequence
  Synthetic
ccgttttttttttttgttgcatc

SEQ ID NO: 11053 - DNA, 23 bp, Artificial Sequence
  Synthetic
ccgttttttttttttatggcggc

SEQ ID NO: 11054 - DNA, 23 bp, Artificial Sequence
  Synthetic
ccgttttttttttttgcgtgctc

SEQ ID NO: 11055 - DNA, 23 bp, Artificial Sequence
  Synthetic
ccgttttttttttttcaccgttg

SEQ ID NO: 11056 - DNA, 23 bp, Artificial Sequence
  Synthetic
ccgttttttttttttcaccgttg

SEQ ID NO: 11057 - DNA, 23 bp, Artificial Sequence
  Synthetic
ccgttttttttttttcaccgttg

SEQ ID NO: 11058 - DNA, 23 bp, Artificial Sequence
  Synthetic
ccgttttttttttttcaccgttg

SEQ ID NO: 11059 - DNA, 23 bp, Artificial Sequence
  Synthetic
ccgttttttttttttcaccgttg

SEQ ID NO: 11060 - DNA, 23 bp, Artificial Sequence
  Synthetic
ccgttttttttttttcaccgttg

SEQ ID NO: 11061 - DNA, 23 bp, Artificial Sequence
  Synthetic
ccgttttttttttttcaccgttg

SEQ ID NO: 11062 - DNA, 23 bp, Artificial Sequence
  Synthetic
ccgttttttttttttcaccgttg

SEQ ID NO: 11063 - DNA, 23 bp, Artificial Sequence
  Synthetic
ccgttttttttttttggattcac

SEQ ID NO: 11064 - DNA, 23 bp, Artificial Sequence
  Synthetic
ccgttttttttttttggattcac

SEQ ID NO: 11065 - DNA, 23 bp, Artificial Sequence
  Synthetic
ccgttttttttttttggattcac

SEQ ID NO: 11066 - DNA, 23 bp, Artificial Sequence
  Synthetic
ccgttttttttttttcttacatt

SEQ ID NO: 11067 - DNA, 23 bp, Artificial Sequence
  Synthetic
ccgttttttttttttattctaac

SEQ ID NO: 11068 - DNA, 23 bp, Artificial Sequence
  Synthetic
ccgttttttttttttattctaac

SEQ ID NO: 11069 - DNA, 23 bp, Artificial Sequence
  Synthetic
ccgttttttttttttattctaac

SEQ ID NO: 11070 - DNA, 23 bp, Artificial Sequence
  Synthetic
ccgttttttttttttattctaac

SEQ ID NO: 11071 - DNA, 23 bp, Artificial Sequence
  Synthetic
ccgttttttttttttattctaac

SEQ ID NO: 11072 - DNA, 23 bp, Artificial Sequence
  Synthetic
ccgttttttttttttattctaac

SEQ ID NO: 11073 - DNA, 23 bp, Artificial Sequence
  Synthetic
ccgttttttttttttattctaac

SEQ ID NO: 11074 - DNA, 23 bp, Artificial Sequence
  Synthetic
ccgttttttttttttattctaac

SEQ ID NO: 11075 - DNA, 23 bp, Artificial Sequence
  Synthetic
ccgttttttttttttccacatgt

SEQ ID NO: 11076 - DNA, 23 bp, Artificial Sequence
  Synthetic
ccgttttttttttttacgtccat

SEQ ID NO: 11077 - DNA, 23 bp, Artificial Sequence
  Synthetic
ccgttttttttttttacgtccat

SEQ ID NO: 11078 - DNA, 23 bp, Artificial Sequence
  Synthetic
ccgttttttttttttacgtccat

SEQ ID NO: 11079 - DNA, 23 bp, Artificial Sequence
  Synthetic
ccgttttttttttttgtccaacg

SEQ ID NO: 11080 - DNA, 23 bp, Artificial Sequence
  Synthetic
ccgttttttttttttgtccaacg

SEQ ID NO: 11081 - DNA, 23 bp, Artificial Sequence
  Synthetic
ccgttttttttttttgtccaacg

SEQ ID NO: 11082 - DNA, 23 bp, Artificial Sequence
  Synthetic
ccgttttttttttttgtccaacg

SEQ ID NO: 11083 - DNA, 23 bp, Artificial Sequence
  Synthetic
ccgttttttttttttgtccaacg

SEQ ID NO: 11084 - DNA, 23 bp, Artificial Sequence
  Synthetic
ccgttttttttttttggtaaaac

SEQ ID NO: 11085 - DNA, 23 bp, Artificial Sequence
  Synthetic
ccgttttttttttttagattcgt

SEQ ID NO: 11086 - DNA, 23 bp, Artificial Sequence
  Synthetic
ccgttttttttttttagattcgt

SEQ ID NO: 11087 - DNA, 23 bp, Artificial Sequence
  Synthetic
ccgttttttttttttagattcgt

SEQ ID NO: 11088 - DNA, 23 bp, Artificial Sequence
  Synthetic
ccgttttttttttttcccaatct

SEQ ID NO: 11089 - DNA, 23 bp, Artificial Sequence
  Synthetic
ccgttttttttttttcccaatct

SEQ ID NO: 11090 - DNA, 23 bp, Artificial Sequence
  Synthetic
ccgttttttttttttcccaatct

SEQ ID NO: 11091 - DNA, 23 bp, Artificial Sequence
  Synthetic
ccgttttttttttttgttgtagt

SEQ ID NO: 11092 - DNA, 23 bp, Artificial Sequence
  Synthetic
ccgttttttttttttcaatcggg

SEQ ID NO: 11093 - DNA, 23 bp, Artificial Sequence
  Synthetic
ccgttttttttttttccgtccca

SEQ ID NO: 11094 - DNA, 23 bp, Artificial Sequence
  Synthetic
ccgttttttttttttccgtccca

SEQ ID NO: 11095 - DNA, 23 bp, Artificial Sequence
  Synthetic
ccgttttttttttttccgtccca

SEQ ID NO: 11096 - DNA, 23 bp, Artificial Sequence
  Synthetic
ccgttttttttttttccgtccca

SEQ ID NO: 11097 - DNA, 23 bp, Artificial Sequence
  Synthetic
ccgttttttttttttccgtccca

SEQ ID NO: 11098 - DNA, 23 bp, Artificial Sequence
  Synthetic
ccgttttttttttttgctagaaa

SEQ ID NO: 11099 - DNA, 23 bp, Artificial Sequence
  Synthetic
ccgttttttttttttgctagaaa

SEQ ID NO: 11100 - DNA, 23 bp, Artificial Sequence
  Synthetic
ccgttttttttttttgctagaaa

SEQ ID NO: 11101 - DNA, 23 bp, Artificial Sequence
  Synthetic
ccgttttttttttttgctagaaa

SEQ ID NO: 11102 - DNA, 23 bp, Artificial Sequence
  Synthetic
ccgttttttttttttgctagaaa

SEQ ID NO: 11103 - DNA, 23 bp, Artificial Sequence
  Synthetic
ccgttttttttttttgctagaaa

SEQ ID NO: 11104 - DNA, 23 bp, Artificial Sequence
  Synthetic
ccgttttttttttttgctagaaa

SEQ ID NO: 11105 - DNA, 23 bp, Artificial Sequence
  Synthetic
ccgttttttttttttgctagaaa

SEQ ID NO: 11106 - DNA, 23 bp, Artificial Sequence
  Synthetic
ccgttttttttttttgctagaaa

SEQ ID NO: 11107 - DNA, 23 bp, Artificial Sequence
  Synthetic
ccgttttttttttttgctagaaa

SEQ ID NO: 11108 - DNA, 23 bp, Artificial Sequence
  Synthetic
ccgttttttttttttgctagaaa

SEQ ID NO: 11109 - DNA, 23 bp, Artificial Sequence
  Synthetic
ccgttttttttttttcctggtcc

SEQ ID NO: 11110 - DNA, 23 bp, Artificial Sequence
  Synthetic
ccgttttttttttttcctggtcc

SEQ ID NO: 11111 - DNA, 23 bp, Artificial Sequence
  Synthetic
ccgttttttttttttcctggtcc

SEQ ID NO: 11112 - DNA, 23 bp, Artificial Sequence
  Synthetic
ccgttttttttttttattcaact

SEQ ID NO: 11113 - DNA, 23 bp, Artificial Sequence
  Synthetic
ccgttttttttttttattcaact

SEQ ID NO: 11114 - DNA, 23 bp, Artificial Sequence
  Synthetic
ccgttttttttttttattcaact

SEQ ID NO: 11115 - DNA, 23 bp, Artificial Sequence
  Synthetic
ccgttttttttttttacatactt

SEQ ID NO: 11116 - DNA, 23 bp, Artificial Sequence
  Synthetic
ccgttttttttttttcacaagtt

SEQ ID NO: 11117 - DNA, 23 bp, Artificial Sequence
  Synthetic
ccgttttttttttttcttcagtt

SEQ ID NO: 11118 - DNA, 23 bp, Artificial Sequence
  Synthetic
ccgttttttttttttcatagccc

SEQ ID NO: 11119 - DNA, 23 bp, Artificial Sequence
  Synthetic
ccgttttttttttttacaggagt

SEQ ID NO: 11120 - DNA, 23 bp, Artificial Sequence
  Synthetic
ccgttttttttttttgctacctg

SEQ ID NO: 11121 - DNA, 23 bp, Artificial Sequence
  Synthetic
ccgttttttttttttatctgcac

SEQ ID NO: 11122 - DNA, 23 bp, Artificial Sequence
  Synthetic
ccgttttttttttttgatagccc

SEQ ID NO: 11123 - DNA, 23 bp, Artificial Sequence
  Synthetic
ccgttttttttttttcacaaatt

SEQ ID NO: 11124 - DNA, 23 bp, Artificial Sequence
  Synthetic
ccgttttttttttttacaaattc

SEQ ID NO: 11125 - DNA, 23 bp, Artificial Sequence
  Synthetic
ccgttttttttttttggcattca

SEQ ID NO: 11126 - DNA, 23 bp, Artificial Sequence
  Synthetic
ccgttttttttttttcacaagtt

SEQ ID NO: 11127 - DNA, 23 bp, Artificial Sequence
  Synthetic
ccgttttttttttttaaaagaga

SEQ ID NO: 11128 - DNA, 23 bp, Artificial Sequence
  Synthetic
ccgttttttttttttgccctttt

SEQ ID NO: 11129 - DNA, 23 bp, Artificial Sequence
  Synthetic
ccgttttttttttttacagctgg

SEQ ID NO: 11130 - DNA, 23 bp, Artificial Sequence
  Synthetic
ccgttttttttttttccctctgg

SEQ ID NO: 11131 - DNA, 23 bp, Artificial Sequence
  Synthetic
ccgttttttttttttcacatagg

SEQ ID NO: 11132 - DNA, 23 bp, Artificial Sequence
  Synthetic
ccgttttttttttttccatcatc

SEQ ID NO: 11133 - DNA, 23 bp, Artificial Sequence
  Synthetic
ccgttttttttttttagacacgt

SEQ ID NO: 11134 - DNA, 23 bp, Artificial Sequence
  Synthetic
ccgttttttttttttgcatcttt

SEQ ID NO: 11135 - DNA, 23 bp, Artificial Sequence
  Synthetic
ccgttttttttttttgagctaca

SEQ ID NO: 11136 - DNA, 23 bp, Artificial Sequence
  Synthetic
ccgttttttttttttgtagtaca

SEQ ID NO: 11137 - DNA, 23 bp, Artificial Sequence
  Synthetic
ccgttttttttttttgcagaagc

SEQ ID NO: 11138 - DNA, 23 bp, Artificial Sequence
  Synthetic
ccgttttttttttttcgaaggca

SEQ ID NO: 11139 - DNA, 23 bp, Artificial Sequence
  Synthetic
ccgttttttttttttcacaaacc

SEQ ID NO: 11140 - DNA, 23 bp, Artificial Sequence
  Synthetic
ccgttttttttttttgtaaacca

SEQ ID NO: 11141 - DNA, 23 bp, Artificial Sequence
  Synthetic
ccgttttttttttttcgccaata

SEQ ID NO: 11142 - DNA, 23 bp, Artificial Sequence
  Synthetic
ccgttttttttttttacaagtgc

SEQ ID NO: 11143 - DNA, 23 bp, Artificial Sequence
  Synthetic
ccgttttttttttttactacctg

SEQ ID NO: 11144 - DNA, 23 bp, Artificial Sequence
  Synthetic
ccgttttttttttttatctgcac

SEQ ID NO: 11145 - DNA, 23 bp, Artificial Sequence
  Synthetic
ccgttttttttttttactcaccg

SEQ ID NO: 11146 - DNA, 23 bp, Artificial Sequence
  Synthetic
ccgttttttttttttggtacaat

SEQ ID NO: 11147 - DNA, 23 bp, Artificial Sequence
  Synthetic
ccgttttttttttttaacccacc

SEQ ID NO: 11148 - DNA, 23 bp, Artificial Sequence
  Synthetic
ccgttttttttttttactcaccg

SEQ ID NO: 11149 - DNA, 23 bp, Artificial Sequence
  Synthetic
ccgttttttttttttcagtgaat

SEQ ID NO: 11150 - DNA, 23 bp, Artificial Sequence
  Synthetic
ccgttttttttttttaagcccaa

SEQ ID NO: 11151 - DNA, 23 bp, Artificial Sequence
  Synthetic
ccgttttttttttttcggctgca

SEQ ID NO: 11152 - DNA, 23 bp, Artificial Sequence
  Synthetic
ccgttttttttttttaccctcca

SEQ ID NO: 11153 - DNA, 23 bp, Artificial Sequence
  Synthetic
ccgttttttttttttactgatat

SEQ ID NO: 11154 - DNA, 23 bp, Artificial Sequence
  Synthetic
ccgttttttttttttacctaata

SEQ ID NO: 11155 - DNA, 23 bp, Artificial Sequence
  Synthetic
ccgttttttttttttgccaatat

SEQ ID NO: 11156 - DNA, 23 bp, Artificial Sequence
  Synthetic
ccgttttttttttttcccaacaa

SEQ ID NO: 11157 - DNA, 23 bp, Artificial Sequence
  Synthetic
ccgttttttttttttgctgggtg

SEQ ID NO: 11158 - DNA, 23 bp, Artificial Sequence
  Synthetic
ccgttttttttttttcctatctc

SEQ ID NO: 11159 - DNA, 23 bp, Artificial Sequence
  Synthetic
ccgttttttttttttgaacaggt

SEQ ID NO: 11160 - DNA, 23 bp, Artificial Sequence
  Synthetic
ccgttttttttttttcagttttg

SEQ ID NO: 11161 - DNA, 23 bp, Artificial Sequence
  Synthetic
ccgttttttttttttcagttttg

SEQ ID NO: 11162 - DNA, 23 bp, Artificial Sequence
  Synthetic
ccgttttttttttttacctgcac

SEQ ID NO: 11163 - DNA, 23 bp, Artificial Sequence
  Synthetic
ccgttttttttttttaggcatag

SEQ ID NO: 11164 - DNA, 23 bp, Artificial Sequence
  Synthetic
ccgttttttttttttcagactcc

SEQ ID NO: 11165 - DNA, 23 bp, Artificial Sequence
  Synthetic
ccgttttttttttttcaacatca

SEQ ID NO: 11166 - DNA, 23 bp, Artificial Sequence
  Synthetic
ccgttttttttttttctgcctgt

SEQ ID NO: 11167 - DNA, 23 bp, Artificial Sequence
  Synthetic
ccgttttttttttttcacagttg

SEQ ID NO: 11168 - DNA, 23 bp, Artificial Sequence
  Synthetic
ccgttttttttttttatccaatc

SEQ ID NO: 11169 - DNA, 23 bp, Artificial Sequence
  Synthetic
ccgttttttttttttacatggtt

SEQ ID NO: 11170 - DNA, 23 bp, Artificial Sequence
  Synthetic
ccgttttttttttttacagttct

SEQ ID NO: 11171 - DNA, 23 bp, Artificial Sequence
  Synthetic
ccgttttttttttttaaagtgtc

SEQ ID NO: 11172 - DNA, 23 bp, Artificial Sequence
  Synthetic
ccgttttttttttttgaaaccca

SEQ ID NO: 11173 - DNA, 23 bp, Artificial Sequence
  Synthetic
ccgttttttttttttggggtatt

SEQ ID NO: 11174 - DNA, 23 bp, Artificial Sequence
  Synthetic
ccgttttttttttttaaacggaa

SEQ ID NO: 11175 - DNA, 23 bp, Artificial Sequence
  Synthetic
ccgttttttttttttggaaatcc

SEQ ID NO: 11176 - DNA, 23 bp, Artificial Sequence
  Synthetic
ccgttttttttttttgtggtaat

SEQ ID NO: 11177 - DNA, 23 bp, Artificial Sequence
  Synthetic
ccgttttttttttttctgttcct

SEQ ID NO: 11178 - DNA, 23 bp, Artificial Sequence
  Synthetic
ccgttttttttttttcagaccga

SEQ ID NO: 11179 - DNA, 23 bp, Artificial Sequence
  Synthetic
ccgttttttttttttagcctatc

SEQ ID NO: 11180 - DNA, 23 bp, Artificial Sequence
  Synthetic
ccgttttttttttttggcggaac

SEQ ID NO: 11181 - DNA, 23 bp, Artificial Sequence
  Synthetic
ccgttttttttttttctcaatag

SEQ ID NO: 11182 - DNA, 23 bp, Artificial Sequence
  Synthetic
ccgttttttttttttaaccgatt

SEQ ID NO: 11183 - DNA, 23 bp, Artificial Sequence
  Synthetic
ccgttttttttttttactgattt

SEQ ID NO: 11184 - DNA, 23 bp, Artificial Sequence
  Synthetic
ccgttttttttttttgctgcaaa

SEQ ID NO: 11185 - DNA, 23 bp, Artificial Sequence
  Synthetic
ccgttttttttttttcttccagt

SEQ ID NO: 11186 - DNA, 23 bp, Artificial Sequence
  Synthetic
ccgttttttttttttgctgagtg

SEQ ID NO: 11187 - DNA, 23 bp, Artificial Sequence
  Synthetic
ccgttttttttttttcttccagt

SEQ ID NO: 11188 - DNA, 23 bp, Artificial Sequence
  Synthetic
ccgttttttttttttcagctatg

SEQ ID NO: 11189 - DNA, 23 bp, Artificial Sequence
  Synthetic
ccgttttttttttttgcaactta

SEQ ID NO: 11190 - DNA, 23 bp, Artificial Sequence
  Synthetic
ccgttttttttttttcaatgcaa

SEQ ID NO: 11191 - DNA, 23 bp, Artificial Sequence
  Synthetic
ccgttttttttttttacaaccag

SEQ ID NO: 11192 - DNA, 23 bp, Artificial Sequence
  Synthetic
ccgttttttttttttaacaaaat

SEQ ID NO: 11193 - DNA, 23 bp, Artificial Sequence
  Synthetic
ccgttttttttttttacaggccg

SEQ ID NO: 11194 - DNA, 23 bp, Artificial Sequence
  Synthetic
ccgttttttttttttctacctgc

SEQ ID NO: 11195 - DNA, 23 bp, Artificial Sequence
  Synthetic
ccgttttttttttttgctcaata

SEQ ID NO: 11196 - DNA, 23 bp, Artificial Sequence
  Synthetic
ccgttttttttttttgcaaaaat

SEQ ID NO: 11197 - DNA, 23 bp, Artificial Sequence
  Synthetic
ccgttttttttttttaacaatac

SEQ ID NO: 11198 - DNA, 23 bp, Artificial Sequence
  Synthetic
ccgttttttttttttcacaagat

SEQ ID NO: 11199 - DNA, 23 bp, Artificial Sequence
  Synthetic
ccgttttttttttttcctctccc

SEQ ID NO: 11200 - DNA, 23 bp, Artificial Sequence
  Synthetic
ccgttttttttttttcttgcata

SEQ ID NO: 11201 - DNA, 23 bp, Artificial Sequence
  Synthetic
ccgttttttttttttcgcattct

SEQ ID NO: 11202 - DNA, 23 bp, Artificial Sequence
  Synthetic
ccgttttttttttttctcccacg

SEQ ID NO: 11203 - DNA, 23 bp, Artificial Sequence
  Synthetic
ccgttttttttttttggccgcga

SEQ ID NO: 11204 - DNA, 23 bp, Artificial Sequence
  Synthetic
ccgttttttttttttcgtataca

SEQ ID NO: 11205 - DNA, 23 bp, Artificial Sequence
  Synthetic
ccgttttttttttttgatacaag

SEQ ID NO: 11206 - DNA, 23 bp, Artificial Sequence
  Synthetic
ccgttttttttttttcttgacat

SEQ ID NO: 11207 - DNA, 23 bp, Artificial Sequence
  Synthetic
ccgttttttttttttcagaggcc

SEQ ID NO: 11208 - DNA, 23 bp, Artificial Sequence
  Synthetic
ccgttttttttttttaagctagt

SEQ ID NO: 11209 - DNA, 23 bp, Artificial Sequence
  Synthetic
ccgttttttttttttaagctagt

SEQ ID NO: 11210 - DNA, 23 bp, Artificial Sequence
  Synthetic
ccgttttttttttttaagctagt

SEQ ID NO: 11211 - DNA, 23 bp, Artificial Sequence
  Synthetic
ccgttttttttttttaagctagt

SEQ ID NO: 11212 - DNA, 23 bp, Artificial Sequence
  Synthetic
ccgttttttttttttcttgaact

SEQ ID NO: 11213 - DNA, 23 bp, Artificial Sequence
  Synthetic
ccgttttttttttttcttgaact

SEQ ID NO: 11214 - DNA, 23 bp, Artificial Sequence
  Synthetic
ccgttttttttttttgaccctgc

SEQ ID NO: 11215 - DNA, 23 bp, Artificial Sequence
  Synthetic
ccgttttttttttttataccaat

SEQ ID NO: 11216 - DNA, 23 bp, Artificial Sequence
  Synthetic
ccgttttttttttttggaggtgt

SEQ ID NO: 11217 - DNA, 23 bp, Artificial Sequence
  Synthetic
ccgttttttttttttgtgctcac

SEQ ID NO: 11218 - DNA, 23 bp, Artificial Sequence
  Synthetic
ccgttttttttttttggagctcc

SEQ ID NO: 11219 - DNA, 23 bp, Artificial Sequence
  Synthetic
ccgttttttttttttggagctcc

SEQ ID NO: 11220 - DNA, 23 bp, Artificial Sequence
  Synthetic
ccgttttttttttttgggagctc

SEQ ID NO: 11221 - DNA, 23 bp, Artificial Sequence
  Synthetic
ccgttttttttttttgggagctc

SEQ ID NO: 11222 - DNA, 23 bp, Artificial Sequence
  Synthetic
ccgttttttttttttggcgctat

SEQ ID NO: 11223 - DNA, 23 bp, Artificial Sequence
  Synthetic
ccgttttttttttttggcgctat

SEQ ID NO: 11224 - DNA, 23 bp, Artificial Sequence
  Synthetic
ccgttttttttttttggcgctat

SEQ ID NO: 11225 - DNA, 23 bp, Artificial Sequence
  Synthetic
ccgttttttttttttccctcaca

SEQ ID NO: 11226 - DNA, 23 bp, Artificial Sequence
  Synthetic
ccgttttttttttttccctcaca

SEQ ID NO: 11227 - DNA, 23 bp, Artificial Sequence
  Synthetic
ccgttttttttttttgtatgcaa

SEQ ID NO: 11228 - DNA, 23 bp, Artificial Sequence
  Synthetic
ccgttttttttttttgcgtgctc

SEQ ID NO: 11229 - DNA, 23 bp, Artificial Sequence
  Synthetic
ccgttttttttttttgcgtgctc

SEQ ID NO: 11230 - DNA, 23 bp, Artificial Sequence
  Synthetic
ccgttttttttttttgcgtgctc

SEQ ID NO: 11231 - DNA, 23 bp, Artificial Sequence
  Synthetic
ccgttttttttttttggcgtgct

SEQ ID NO: 11232 - DNA, 23 bp, Artificial Sequence
  Synthetic
ccgttttttttttttgttgcaca

SEQ ID NO: 11233 - DNA, 23 bp, Artificial Sequence
  Synthetic
ccgttttttttttttagcctgta

SEQ ID NO: 11234 - DNA, 23 bp, Artificial Sequence
  Synthetic
ccgttttttttttttagcctgta

SEQ ID NO: 11235 - DNA, 23 bp, Artificial Sequence
  Synthetic
ccgttttttttttttccagacat

SEQ ID NO: 11236 - DNA, 23 bp, Artificial Sequence
  Synthetic
ccgttttttttttttccagacat

SEQ ID NO: 11237 - DNA, 23 bp, Artificial Sequence
  Synthetic
ccgttttttttttttccagacat

SEQ ID NO: 11238 - DNA, 23 bp, Artificial Sequence
  Synthetic
ccgttttttttttttcacaagtt

SEQ ID NO: 11239 - DNA, 23 bp, Artificial Sequence
  Synthetic
ccgttttttttttttcttcagtt

SEQ ID NO: 11240 - DNA, 23 bp, Artificial Sequence
  Synthetic
ccgttttttttttttcatagccc

SEQ ID NO: 11241 - DNA, 23 bp, Artificial Sequence
  Synthetic
ccgttttttttttttacaggagt

SEQ ID NO: 11242 - DNA, 23 bp, Artificial Sequence
  Synthetic
ccgttttttttttttgctacctg

SEQ ID NO: 11243 - DNA, 23 bp, Artificial Sequence
  Synthetic
ccgttttttttttttatctgcac

SEQ ID NO: 11244 - DNA, 23 bp, Artificial Sequence
  Synthetic
ccgttttttttttttgatagccc

SEQ ID NO: 11245 - DNA, 23 bp, Artificial Sequence
  Synthetic
ccgttttttttttttcacaaatt

SEQ ID NO: 11246 - DNA, 23 bp, Artificial Sequence
  Synthetic
ccgttttttttttttggcattca

SEQ ID NO: 11247 - DNA, 23 bp, Artificial Sequence
  Synthetic
ccgttttttttttttcacaagtt

SEQ ID NO: 11248 - DNA, 23 bp, Artificial Sequence
  Synthetic
ccgttttttttttttagccaagc

SEQ ID NO: 11249 - DNA, 23 bp, Artificial Sequence
  Synthetic
ccgttttttttttttaaaagaga

SEQ ID NO: 11250 - DNA, 23 bp, Artificial Sequence
  Synthetic
ccgttttttttttttacagctgg

SEQ ID NO: 11251 - DNA, 23 bp, Artificial Sequence
  Synthetic
ccgttttttttttttccctctgg

SEQ ID NO: 11252 - DNA, 23 bp, Artificial Sequence
  Synthetic
ccgttttttttttttcacatagg

SEQ ID NO: 11253 - DNA, 23 bp, Artificial Sequence
  Synthetic
ccgttttttttttttccatcatc

SEQ ID NO: 11254 - DNA, 23 bp, Artificial Sequence
  Synthetic
ccgttttttttttttccatcttt

SEQ ID NO: 11255 - DNA, 23 bp, Artificial Sequence
  Synthetic
ccgttttttttttttgagctaca

SEQ ID NO: 11256 - DNA, 23 bp, Artificial Sequence
  Synthetic
ccgttttttttttttctagtaca

SEQ ID NO: 11257 - DNA, 23 bp, Artificial Sequence
  Synthetic
ccgttttttttttttaagggatt

SEQ ID NO: 11258 - DNA, 23 bp, Artificial Sequence
  Synthetic
ccgttttttttttttgcagaagc

SEQ ID NO: 11259 - DNA, 23 bp, Artificial Sequence
  Synthetic
ccgttttttttttttcacttttg

SEQ ID NO: 11260 - DNA, 23 bp, Artificial Sequence
  Synthetic
ccgttttttttttttcgaaggca

SEQ ID NO: 11261 - DNA, 23 bp, Artificial Sequence
  Synthetic
ccgttttttttttttcacaaacc

SEQ ID NO: 11262 - DNA, 23 bp, Artificial Sequence
  Synthetic
ccgttttttttttttgtaaacca

SEQ ID NO: 11263 - DNA, 23 bp, Artificial Sequence
  Synthetic
ccgttttttttttttcgccaata

SEQ ID NO: 11264 - DNA, 23 bp, Artificial Sequence
  Synthetic
ccgttttttttttttacaagtgc

SEQ ID NO: 11265 - DNA, 23 bp, Artificial Sequence
  Synthetic
ccgttttttttttttactacctg

SEQ ID NO: 11266 - DNA, 23 bp, Artificial Sequence
  Synthetic
ccgttttttttttttatctgcac

SEQ ID NO: 11267 - DNA, 23 bp, Artificial Sequence
  Synthetic
ccgttttttttttttactcaccg

SEQ ID NO: 11268 - DNA, 23 bp, Artificial Sequence
  Synthetic
ccgttttttttttttggtacaat

SEQ ID NO: 11269 - DNA, 23 bp, Artificial Sequence
  Synthetic
ccgttttttttttttaacccacc

SEQ ID NO: 11270 - DNA, 23 bp, Artificial Sequence
  Synthetic
ccgttttttttttttgtgagttc

SEQ ID NO: 11271 - DNA, 23 bp, Artificial Sequence
  Synthetic
ccgttttttttttttacccttat

SEQ ID NO: 11272 - DNA, 23 bp, Artificial Sequence
  Synthetic
ccgttttttttttttcggctgca

SEQ ID NO: 11273 - DNA, 23 bp, Artificial Sequence
  Synthetic
ccgttttttttttttaccctcca

SEQ ID NO: 11274 - DNA, 23 bp, Artificial Sequence
  Synthetic
ccgttttttttttttactgatat

SEQ ID NO: 11275 - DNA, 23 bp, Artificial Sequence
  Synthetic
ccgttttttttttttccacatgg

SEQ ID NO: 11276 - DNA, 23 bp, Artificial Sequence
  Synthetic
ccgttttttttttttccaacaac

SEQ ID NO: 11277 - DNA, 23 bp, Artificial Sequence
  Synthetic
ccgttttttttttttcccaacaa

SEQ ID NO: 11278 - DNA, 23 bp, Artificial Sequence
  Synthetic
ccgttttttttttttgctgggtg

SEQ ID NO: 11279 - DNA, 23 bp, Artificial Sequence
  Synthetic
ccgttttttttttttcctatctc

SEQ ID NO: 11280 - DNA, 23 bp, Artificial Sequence
  Synthetic
ccgttttttttttttgaacaggt

SEQ ID NO: 11281 - DNA, 23 bp, Artificial Sequence
  Synthetic
ccgttttttttttttcagttttg

SEQ ID NO: 11282 - DNA, 23 bp, Artificial Sequence
  Synthetic
ccgttttttttttttcagttttg

SEQ ID NO: 11283 - DNA, 23 bp, Artificial Sequence
  Synthetic
ccgttttttttttttacctgcac

SEQ ID NO: 11284 - DNA, 23 bp, Artificial Sequence
  Synthetic
ccgttttttttttttccatcatt

SEQ ID NO: 11285 - DNA, 23 bp, Artificial Sequence
  Synthetic
ccgttttttttttttaggcatag

SEQ ID NO: 11286 - DNA, 23 bp, Artificial Sequence
  Synthetic
ccgttttttttttttccacacac

SEQ ID NO: 11287 - DNA, 23 bp, Artificial Sequence
  Synthetic
ccgttttttttttttcaacatca

SEQ ID NO: 11288 - DNA, 23 bp, Artificial Sequence
  Synthetic
ccgttttttttttttaggcgaag

SEQ ID NO: 11289 - DNA, 23 bp, Artificial Sequence
  Synthetic
ccgttttttttttttctgcctgt

SEQ ID NO: 11290 - DNA, 23 bp, Artificial Sequence
  Synthetic
ccgttttttttttttgtctgtca

SEQ ID NO: 11291 - DNA, 23 bp, Artificial Sequence
  Synthetic
ccgttttttttttttcacagttg

SEQ ID NO: 11292 - DNA, 23 bp, Artificial Sequence
  Synthetic
ccgttttttttttttacatggtt

SEQ ID NO: 11293 - DNA, 23 bp, Artificial Sequence
  Synthetic
ccgttttttttttttagaattgc

SEQ ID NO: 11294 - DNA, 23 bp, Artificial Sequence
  Synthetic
ccgttttttttttttacagttct

SEQ ID NO: 11295 - DNA, 23 bp, Artificial Sequence
  Synthetic
ccgttttttttttttgaaaccca

SEQ ID NO: 11296 - DNA, 23 bp, Artificial Sequence
  Synthetic
ccgttttttttttttggggtatt

SEQ ID NO: 11297 - DNA, 23 bp, Artificial Sequence
  Synthetic
ccgttttttttttttaaacggaa

SEQ ID NO: 11298 - DNA, 23 bp, Artificial Sequence
  Synthetic
ccgttttttttttttggaaatcc

SEQ ID NO: 11299 - DNA, 23 bp, Artificial Sequence
  Synthetic
ccgttttttttttttgtggtaat

SEQ ID NO: 11300 - DNA, 23 bp, Artificial Sequence
  Synthetic
ccgttttttttttttctgttcct

SEQ ID NO: 11301 - DNA, 23 bp, Artificial Sequence
  Synthetic
ccgttttttttttttcagaccga

SEQ ID NO: 11302 - DNA, 23 bp, Artificial Sequence
  Synthetic
ccgttttttttttttagcctatc

SEQ ID NO: 11303 - DNA, 23 bp, Artificial Sequence
  Synthetic
ccgttttttttttttggcggaac

SEQ ID NO: 11304 - DNA, 23 bp, Artificial Sequence
  Synthetic
ccgttttttttttttctcaatag

SEQ ID NO: 11305 - DNA, 23 bp, Artificial Sequence
  Synthetic
ccgttttttttttttaaccgatt

SEQ ID NO: 11306 - DNA, 23 bp, Artificial Sequence
  Synthetic
ccgttttttttttttactgattt

SEQ ID NO: 11307 - DNA, 23 bp, Artificial Sequence
  Synthetic
ccgttttttttttttgctgcaaa

SEQ ID NO: 11308 - DNA, 23 bp, Artificial Sequence
  Synthetic
ccgttttttttttttcttccagt

SEQ ID NO: 11309 - DNA, 23 bp, Artificial Sequence
  Synthetic
ccgttttttttttttcagctatg

SEQ ID NO: 11310 - DNA, 23 bp, Artificial Sequence
  Synthetic
ccgttttttttttttgcaactta

SEQ ID NO: 11311 - DNA, 23 bp, Artificial Sequence
  Synthetic
ccgttttttttttttcaatgcaa

SEQ ID NO: 11312 - DNA, 23 bp, Artificial Sequence
  Synthetic
ccgttttttttttttacaaccag

SEQ ID NO: 11313 - DNA, 23 bp, Artificial Sequence
  Synthetic
ccgttttttttttttaacaaaat

SEQ ID NO: 11314 - DNA, 23 bp, Artificial Sequence
  Synthetic
ccgttttttttttttacaggccg

SEQ ID NO: 11315 - DNA, 23 bp, Artificial Sequence
  Synthetic
ccgttttttttttttctacctgc

SEQ ID NO: 11316 - DNA, 23 bp, Artificial Sequence
  Synthetic
ccgttttttttttttgctcaata

SEQ ID NO: 11317 - DNA, 23 bp, Artificial Sequence
  Synthetic
ccgttttttttttttaacaatac

SEQ ID NO: 11318 - DNA, 23 bp, Artificial Sequence
  Synthetic
ccgttttttttttttcacaagat

SEQ ID NO: 11319 - DNA, 23 bp, Artificial Sequence
  Synthetic
ccgttttttttttttgtgctcac

SEQ ID NO: 11320 - DNA, 23 bp, Artificial Sequence
  Synthetic
ccgttttttttttttgtgctcac

SEQ ID NO: 11321 - DNA, 23 bp, Artificial Sequence
  Synthetic
ccgttttttttttttgtgctcac

SEQ ID NO: 11322 - DNA, 23 bp, Artificial Sequence
  Synthetic
ccgttttttttttttgtgctcac

SEQ ID NO: 11323 - DNA, 23 bp, Artificial Sequence
  Synthetic
ccgttttttttttttgtgctcac

SEQ ID NO: 11324 - DNA, 23 bp, Artificial Sequence
  Synthetic
ccgttttttttttttgtgctcac

SEQ ID NO: 11325 - DNA, 23 bp, Artificial Sequence
  Synthetic
ccgttttttttttttgtgctctc

SEQ ID NO: 11326 - DNA, 23 bp, Artificial Sequence
  Synthetic
ccgttttttttttttgtgctctc

SEQ ID NO: 11327 - DNA, 23 bp, Artificial Sequence
  Synthetic
ccgttttttttttttgtgctctc

SEQ ID NO: 11328 - DNA, 23 bp, Artificial Sequence
  Synthetic
ccgttttttttttttgtgctctc

SEQ ID NO: 11329 - DNA, 23 bp, Artificial Sequence
  Synthetic
ccgttttttttttttgtgctccc

SEQ ID NO: 11330 - DNA, 23 bp, Artificial Sequence
  Synthetic
ccgttttttttttttagagctcc

SEQ ID NO: 11331 - DNA, 23 bp, Artificial Sequence
  Synthetic
ccgttttttttttttagagctcc

SEQ ID NO: 11332 - DNA, 23 bp, Artificial Sequence
  Synthetic
ccgttttttttttttagagctcc

SEQ ID NO: 11333 - DNA, 23 bp, Artificial Sequence
  Synthetic
ccgttttttttttttaggagctc

SEQ ID NO: 11334 - DNA, 23 bp, Artificial Sequence
  Synthetic
ccgttttttttttttaggagctc

SEQ ID NO: 11335 - DNA, 23 bp, Artificial Sequence
  Synthetic
ccgttttttttttttcgagctcc

SEQ ID NO: 11336 - DNA, 23 bp, Artificial Sequence
  Synthetic
ccgttttttttttttggcataca

SEQ ID NO: 11337 - DNA, 23 bp, Artificial Sequence
  Synthetic
ccgttttttttttttggcataca

SEQ ID NO: 11338 - DNA, 23 bp, Artificial Sequence
  Synthetic
ccgttttttttttttggcataca

SEQ ID NO: 11339 - DNA, 23 bp, Artificial Sequence
  Synthetic
ccgttttttttttttggcataca

SEQ ID NO: 11340 - DNA, 23 bp, Artificial Sequence
  Synthetic
ccgttttttttttttggcattca

SEQ ID NO: 11341 - DNA, 23 bp, Artificial Sequence
  Synthetic
ccgttttttttttttggcattca

SEQ ID NO: 11342 - DNA, 23 bp, Artificial Sequence
  Synthetic
ccgttttttttttttggcatcca

SEQ ID NO: 11343 - DNA, 23 bp, Artificial Sequence
  Synthetic
ccgttttttttttttggcatgca

SEQ ID NO: 11344 - DNA, 23 bp, Artificial Sequence
  Synthetic
ccgttttttttttttctggatgc

SEQ ID NO: 11345 - DNA, 23 bp, Artificial Sequence
  Synthetic
ccgttttttttttttctggatgc

SEQ ID NO: 11346 - DNA, 23 bp, Artificial Sequence
  Synthetic
ccgttttttttttttctggatgc

SEQ ID NO: 11347 - DNA, 23 bp, Artificial Sequence
  Synthetic
ccgttttttttttttgcacgtgc

SEQ ID NO: 11348 - DNA, 23 bp, Artificial Sequence
  Synthetic
ccgttttttttttttgcacgtgc

SEQ ID NO: 11349 - DNA, 23 bp, Artificial Sequence
  Synthetic
ccgttttttttttttgcacgtgc

SEQ ID NO: 11350 - DNA, 23 bp, Artificial Sequence
  Synthetic
ccgttttttttttttgcacgtgc

SEQ ID NO: 11351 - DNA, 23 bp, Artificial Sequence
  Synthetic
ccgttttttttttttgcacgtgc

SEQ ID NO: 11352 - DNA, 23 bp, Artificial Sequence
  Synthetic
ccgttttttttttttagcatgtg

SEQ ID NO: 11353 - DNA, 23 bp, Artificial Sequence
  Synthetic
ccgttttttttttttggggaatg

SEQ ID NO: 11354 - DNA, 23 bp, Artificial Sequence
  Synthetic
ccgttttttttttttggggaatg

SEQ ID NO: 11355 - DNA, 23 bp, Artificial Sequence
  Synthetic
ccgttttttttttttggggaatg

SEQ ID NO: 11356 - DNA, 23 bp, Artificial Sequence
  Synthetic
ccgttttttttttttggggaatg

SEQ ID NO: 11357 - DNA, 23 bp, Artificial Sequence
  Synthetic
ccgttttttttttttggggaatg

SEQ ID NO: 11358 - DNA, 23 bp, Artificial Sequence
  Synthetic
ccgttttttttttttggggaatg

SEQ ID NO: 11359 - DNA, 23 bp, Artificial Sequence
  Synthetic
ccgttttttttttttggggaatg

SEQ ID NO: 11360 - DNA, 23 bp, Artificial Sequence
  Synthetic
ccgttttttttttttggggaatg

SEQ ID NO: 11361 - DNA, 23 bp, Artificial Sequence
  Synthetic
ccgttttttttttttggggaatg

SEQ ID NO: 11362 - DNA, 23 bp, Artificial Sequence
  Synthetic
ccgttttttttttttggggaatg

SEQ ID NO: 11363 - DNA, 23 bp, Artificial Sequence
  Synthetic
ccgttttttttttttggggaatg

SEQ ID NO: 11364 - DNA, 23 bp, Artificial Sequence
  Synthetic
ccgttttttttttttggggaatg

SEQ ID NO: 11365 - DNA, 23 bp, Artificial Sequence
  Synthetic
ccgttttttttttttggggaatg

SEQ ID NO: 11366 - DNA, 23 bp, Artificial Sequence
  Synthetic
ccgttttttttttttaaggaatg

SEQ ID NO: 11367 - DNA, 23 bp, Artificial Sequence
  Synthetic
ccgttttttttttttaaggaatg

SEQ ID NO: 11368 - DNA, 23 bp, Artificial Sequence
  Synthetic
ccgttttttttttttaaggaatg

SEQ ID NO: 11369 - DNA, 23 bp, Artificial Sequence
  Synthetic
ccgttttttttttttaaggaatg

SEQ ID NO: 11370 - DNA, 23 bp, Artificial Sequence
  Synthetic
ccgttttttttttttagatcatg

SEQ ID NO: 11371 - DNA, 23 bp, Artificial Sequence
  Synthetic
ccgttttttttttttagatcatg

SEQ ID NO: 11372 - DNA, 23 bp, Artificial Sequence
  Synthetic
ccgttttttttttttagatcatg

SEQ ID NO: 11373 - DNA, 23 bp, Artificial Sequence
  Synthetic
ccgttttttttttttagatcatg

SEQ ID NO: 11374 - DNA, 23 bp, Artificial Sequence
  Synthetic
ccgttttttttttttcagatcat

SEQ ID NO: 11375 - DNA, 23 bp, Artificial Sequence
  Synthetic
ccgttttttttttttaagatcat

SEQ ID NO: 11376 - DNA, 23 bp, Artificial Sequence
  Synthetic
ccgttttttttttttaagatcat

SEQ ID NO: 11377 - DNA, 23 bp, Artificial Sequence
  Synthetic
ccgttttttttttttcagatcat

SEQ ID NO: 11378 - DNA, 23 bp, Artificial Sequence
  Synthetic
ccgttttttttttttcccgacct

SEQ ID NO: 11379 - DNA, 23 bp, Artificial Sequence
  Synthetic
ccgttttttttttttcccgacct

SEQ ID NO: 11380 - DNA, 23 bp, Artificial Sequence
  Synthetic
ccgttttttttttttcggcaagt

SEQ ID NO: 11381 - DNA, 23 bp, Artificial Sequence
  Synthetic
ccgttttttttttttccgacaag

SEQ ID NO: 11382 - DNA, 23 bp, Artificial Sequence
  Synthetic
ccgttttttttttttgggcaagt

SEQ ID NO: 11383 - DNA, 23 bp, Artificial Sequence
  Synthetic
ccgttttttttttttgggcaagt

SEQ ID NO: 11384 - DNA, 23 bp, Artificial Sequence
  Synthetic
ccgttttttttttttgggcaagt

SEQ ID NO: 11385 - DNA, 23 bp, Artificial Sequence
  Synthetic
ccgttttttttttttgggcaagt

SEQ ID NO: 11386 - DNA, 23 bp, Artificial Sequence
  Synthetic
ccgttttttttttttgggcaagt

SEQ ID NO: 11387 - DNA, 23 bp, Artificial Sequence
  Synthetic
ccgttttttttttttcggcaagt

SEQ ID NO: 11388 - DNA, 23 bp, Artificial Sequence
  Synthetic
ccgttttttttttttcggcaagt

SEQ ID NO: 11389 - DNA, 23 bp, Artificial Sequence
  Synthetic
ccgttttttttttttccggcaag

SEQ ID NO: 11390 - DNA, 23 bp, Artificial Sequence
  Synthetic
ccgttttttttttttccggcaag

SEQ ID NO: 11391 - DNA, 23 bp, Artificial Sequence
  Synthetic
ccgttttttttttttccggcaag

SEQ ID NO: 11392 - DNA, 23 bp, Artificial Sequence
  Synthetic
ccgttttttttttttccggcaag

SEQ ID NO: 11393 - DNA, 23 bp, Artificial Sequence
  Synthetic
ccgttttttttttttccggcaag

SEQ ID NO: 11394 - DNA, 23 bp, Artificial Sequence
  Synthetic
ccgttttttttttttcaggcaag

SEQ ID NO: 11395 - DNA, 23 bp, Artificial Sequence
  Synthetic
ccgttttttttttttcaggcaag

SEQ ID NO: 11396 - DNA, 23 bp, Artificial Sequence
  Synthetic
ccgttttttttttttcaggcaag

SEQ ID NO: 11397 - DNA, 23 bp, Artificial Sequence
  Synthetic
ccgttttttttttttcaggcaag

SEQ ID NO: 11398 - DNA, 23 bp, Artificial Sequence
  Synthetic
ccgttttttttttttcaggcaag

SEQ ID NO: 11399 - DNA, 23 bp, Artificial Sequence
  Synthetic
ccgttttttttttttcggcaagt

SEQ ID NO: 11400 - DNA, 23 bp, Artificial Sequence
  Synthetic
ccgttttttttttttcaggcaag

SEQ ID NO: 11401 - DNA, 23 bp, Artificial Sequence
  Synthetic
ccgttttttttttttcaggcaag

SEQ ID NO: 11402 - DNA, 23 bp, Artificial Sequence
  Synthetic
ccgttttttttttttcaggcaag

SEQ ID NO: 11403 - DNA, 23 bp, Artificial Sequence
  Synthetic
ccgttttttttttttaggcaagt

SEQ ID NO: 11404 - DNA, 23 bp, Artificial Sequence
  Synthetic
ccgttttttttttttcggcaagt

SEQ ID NO: 11405 - DNA, 23 bp, Artificial Sequence
  Synthetic
ccgttttttttttttccggcaag

SEQ ID NO: 11406 - DNA, 23 bp, Artificial Sequence
  Synthetic
ccgttttttttttttaggcaagt

SEQ ID NO: 11407 - DNA, 23 bp, Artificial Sequence
  Synthetic
ccgttttttttttttgggcaagt

SEQ ID NO: 11408 - DNA, 23 bp, Artificial Sequence
  Synthetic
ccgttttttttttttgggcaagt

SEQ ID NO: 11409 - DNA, 23 bp, Artificial Sequence
  Synthetic
ccgttttttttttttcgagcaag

SEQ ID NO: 11410 - DNA, 23 bp, Artificial Sequence
  Synthetic
ccgttttttttttttcaggcaat

SEQ ID NO: 11411 - DNA, 23 bp, Artificial Sequence
  Synthetic
ccgttttttttttttccggcaaa

SEQ ID NO: 11412 - DNA, 23 bp, Artificial Sequence
  Synthetic
ccgttttttttttttcgtgatat

SEQ ID NO: 11413 - DNA, 23 bp, Artificial Sequence
  Synthetic
ccgttttttttttttcgtgatat

SEQ ID NO: 11414 - DNA, 23 bp, Artificial Sequence
  Synthetic
ccgttttttttttttgatattgg

SEQ ID NO: 11415 - DNA, 23 bp, Artificial Sequence
  Synthetic
ccgttttttttttttgatattgg

SEQ ID NO: 11416 - DNA, 23 bp, Artificial Sequence
  Synthetic
ccgttttttttttttgatattgg

SEQ ID NO: 11417 - DNA, 23 bp, Artificial Sequence
  Synthetic
ccgttttttttttttgatattgg

SEQ ID NO: 11418 - DNA, 23 bp, Artificial Sequence
  Synthetic
ccgttttttttttttgatattgg

SEQ ID NO: 11419 - DNA, 23 bp, Artificial Sequence
  Synthetic
ccgttttttttttttgatattgg

SEQ ID NO: 11420 - DNA, 23 bp, Artificial Sequence
  Synthetic
ccgttttttttttttgatattgg

SEQ ID NO: 11421 - DNA, 23 bp, Artificial Sequence
  Synthetic
ccgttttttttttttagtattgg

SEQ ID NO: 11422 - DNA, 23 bp, Artificial Sequence
  Synthetic
ccgttttttttttttgatattgg

SEQ ID NO: 11423 - DNA, 23 bp, Artificial Sequence
  Synthetic
ccgttttttttttttatgcagca

SEQ ID NO: 11424 - DNA, 23 bp, Artificial Sequence
  Synthetic
ccgttttttttttttatgcagca

SEQ ID NO: 11425 - DNA, 23 bp, Artificial Sequence
  Synthetic
ccgttttttttttttatgcagca

SEQ ID NO: 11426 - DNA, 23 bp, Artificial Sequence
  Synthetic
ccgttttttttttttatgcagca

SEQ ID NO: 11427 - DNA, 23 bp, Artificial Sequence
  Synthetic
ccgttttttttttttatgcagca

SEQ ID NO: 11428 - DNA, 23 bp, Artificial Sequence
  Synthetic
ccgttttttttttttatgcagca

SEQ ID NO: 11429 - DNA, 23 bp, Artificial Sequence
  Synthetic
ccgttttttttttttctgcagca

SEQ ID NO: 11430 - DNA, 23 bp, Artificial Sequence
  Synthetic
ccgttttttttttttctgcagca

SEQ ID NO: 11431 - DNA, 23 bp, Artificial Sequence
  Synthetic
ccgttttttttttttgcagcatc

SEQ ID NO: 11432 - DNA, 23 bp, Artificial Sequence
  Synthetic
ccgttttttttttttgggagctc

SEQ ID NO: 11433 - DNA, 23 bp, Artificial Sequence
  Synthetic
ccgttttttttttttgggagctc

SEQ ID NO: 11434 - DNA, 23 bp, Artificial Sequence
  Synthetic
ccgttttttttttttgggagctc

SEQ ID NO: 11435 - DNA, 23 bp, Artificial Sequence
  Synthetic
ccgttttttttttttgggagctc

SEQ ID NO: 11436 - DNA, 23 bp, Artificial Sequence
  Synthetic
ccgttttttttttttaggagctc

SEQ ID NO: 11437 - DNA, 23 bp, Artificial Sequence
  Synthetic
ccgttttttttttttaggagctc

SEQ ID NO: 11438 - DNA, 23 bp, Artificial Sequence
  Synthetic
ccgttttttttttttaggagctc

SEQ ID NO: 11439 - DNA, 23 bp, Artificial Sequence
  Synthetic
ccgttttttttttttaggagctc

SEQ ID NO: 11440 - DNA, 23 bp, Artificial Sequence
  Synthetic
ccgttttttttttttgggagctc

SEQ ID NO: 11441 - DNA, 23 bp, Artificial Sequence
  Synthetic
ccgttttttttttttggcgctat

SEQ ID NO: 11442 - DNA, 23 bp, Artificial Sequence
  Synthetic
ccgttttttttttttggcgctat

SEQ ID NO: 11443 - DNA, 23 bp, Artificial Sequence
  Synthetic
ccgttttttttttttggcgctat

SEQ ID NO: 11444 - DNA, 23 bp, Artificial Sequence
  Synthetic
ccgttttttttttttggcgctat

SEQ ID NO: 11445 - DNA, 23 bp, Artificial Sequence
  Synthetic
ccgttttttttttttgatcaatg

SEQ ID NO: 11446 - DNA, 23 bp, Artificial Sequence
  Synthetic
ccgttttttttttttgatcaatg

SEQ ID NO: 11447 - DNA, 23 bp, Artificial Sequence
  Synthetic
ccgttttttttttttgatcaatg

SEQ ID NO: 11448 - DNA, 23 bp, Artificial Sequence
  Synthetic
ccgttttttttttttgatcaatg

SEQ ID NO: 11449 - DNA, 23 bp, Artificial Sequence
  Synthetic
ccgttttttttttttggaggtgg

SEQ ID NO: 11450 - DNA, 23 bp, Artificial Sequence
  Synthetic
ccgttttttttttttggaggtgg

SEQ ID NO: 11451 - DNA, 23 bp, Artificial Sequence
  Synthetic
ccgttttttttttttgagttcct

SEQ ID NO: 11452 - DNA, 23 bp, Artificial Sequence
  Synthetic
ccgttttttttttttgagttccc

SEQ ID NO: 11453 - DNA, 23 bp, Artificial Sequence
  Synthetic
ccgttttttttttttgagttccc

SEQ ID NO: 11454 - DNA, 23 bp, Artificial Sequence
  Synthetic
ccgttttttttttttgagttccc

SEQ ID NO: 11455 - DNA, 23 bp, Artificial Sequence
  Synthetic
ccgttttttttttttgagttccc

SEQ ID NO: 11456 - DNA, 23 bp, Artificial Sequence
  Synthetic
ccgttttttttttttgagttccc

SEQ ID NO: 11457 - DNA, 23 bp, Artificial Sequence
  Synthetic
ccgttttttttttttgagttccc

SEQ ID NO: 11458 - DNA, 23 bp, Artificial Sequence
  Synthetic
ccgttttttttttttgagttccc

SEQ ID NO: 11459 - DNA, 23 bp, Artificial Sequence
  Synthetic
ccgttttttttttttgagttccc

SEQ ID NO: 11460 - DNA, 23 bp, Artificial Sequence
  Synthetic
ccgttttttttttttgagttccc

SEQ ID NO: 11461 - DNA, 23 bp, Artificial Sequence
  Synthetic
ccgttttttttttttcagttcaa

SEQ ID NO: 11462 - DNA, 23 bp, Artificial Sequence
  Synthetic
ccgttttttttttttcagttcaa

SEQ ID NO: 11463 - DNA, 23 bp, Artificial Sequence
  Synthetic
ccgttttttttttttaagttcaa

SEQ ID NO: 11464 - DNA, 23 bp, Artificial Sequence
  Synthetic
ccgttttttttttttaagttcaa

SEQ ID NO: 11465 - DNA, 23 bp, Artificial Sequence
  Synthetic
ccgttttttttttttaagttcaa

SEQ ID NO: 11466 - DNA, 23 bp, Artificial Sequence
  Synthetic
ccgttttttttttttcagttcaa

SEQ ID NO: 11467 - DNA, 23 bp, Artificial Sequence
  Synthetic
ccgttttttttttttaagttcaa

SEQ ID NO: 11468 - DNA, 23 bp, Artificial Sequence
  Synthetic
ccgttttttttttttcatcaacg

SEQ ID NO: 11469 - DNA, 23 bp, Artificial Sequence
  Synthetic
ccgttttttttttttcatcaacg

SEQ ID NO: 11470 - DNA, 23 bp, Artificial Sequence
  Synthetic
ccgttttttttttttcatcaaag

SEQ ID NO: 11471 - DNA, 23 bp, Artificial Sequence
  Synthetic
ccgttttttttttttaaggggtg

SEQ ID NO: 11472 - DNA, 23 bp, Artificial Sequence
  Synthetic
ccgttttttttttttcaggggcg

SEQ ID NO: 11473 - DNA, 23 bp, Artificial Sequence
  Synthetic
ccgttttttttttttcaggggcg

SEQ ID NO: 11474 - DNA, 23 bp, Artificial Sequence
  Synthetic
ccgttttttttttttcggggcaa

SEQ ID NO: 11475 - DNA, 23 bp, Artificial Sequence
  Synthetic
ccgttttttttttttccgggcaa

SEQ ID NO: 11476 - DNA, 23 bp, Artificial Sequence
  Synthetic
ccgttttttttttttccgggcaa

SEQ ID NO: 11477 - DNA, 23 bp, Artificial Sequence
  Synthetic
ccgttttttttttttcggggcaa

SEQ ID NO: 11478 - DNA, 23 bp, Artificial Sequence
  Synthetic
ccgttttttttttttcggggcaa

SEQ ID NO: 11479 - DNA, 23 bp, Artificial Sequence
  Synthetic
ccgttttttttttttcagggcaa

SEQ ID NO: 11480 - DNA, 23 bp, Artificial Sequence
  Synthetic
ccgttttttttttttcagggcaa

SEQ ID NO: 11481 - DNA, 23 bp, Artificial Sequence
  Synthetic
ccgttttttttttttcagggaaa

SEQ ID NO: 11482 - DNA, 23 bp, Artificial Sequence
  Synthetic
ccgttttttttttttagggcaac

SEQ ID NO: 11483 - DNA, 23 bp, Artificial Sequence
  Synthetic
ccgttttttttttttccggacaa

SEQ ID NO: 11484 - DNA, 23 bp, Artificial Sequence
  Synthetic
ccgttttttttttttgtgagcaa

SEQ ID NO: 11485 - DNA, 23 bp, Artificial Sequence
  Synthetic
ccgttttttttttttgagggcaa

SEQ ID NO: 11486 - DNA, 23 bp, Artificial Sequence
  Synthetic
ccgttttttttttttcgagtttg

SEQ ID NO: 11487 - DNA, 23 bp, Artificial Sequence
  Synthetic
ccgttttttttttttcgagtttg

SEQ ID NO: 11488 - DNA, 23 bp, Artificial Sequence
  Synthetic
ccgttttttttttttcgagtttg

SEQ ID NO: 11489 - DNA, 23 bp, Artificial Sequence
  Synthetic
ccgttttttttttttgccaggga

SEQ ID NO: 11490 - DNA, 23 bp, Artificial Sequence
  Synthetic
ccgttttttttttttgggatggg

SEQ ID NO: 11491 - DNA, 23 bp, Artificial Sequence
  Synthetic
ccgttttttttttttgggatggg

SEQ ID NO: 11492 - DNA, 23 bp, Artificial Sequence
  Synthetic
ccgttttttttttttggaagcct

SEQ ID NO: 11493 - DNA, 23 bp, Artificial Sequence
  Synthetic
ccgttttttttttttggaagccc

SEQ ID NO: 11494 - DNA, 23 bp, Artificial Sequence
  Synthetic
ccgttttttttttttcccagcca

SEQ ID NO: 11495 - DNA, 23 bp, Artificial Sequence
  Synthetic
ccgttttttttttttcccagcca

SEQ ID NO: 11496 - DNA, 23 bp, Artificial Sequence
  Synthetic
ccgttttttttttttcccagcca

SEQ ID NO: 11497 - DNA, 23 bp, Artificial Sequence
  Synthetic
ccgttttttttttttcttaatca

SEQ ID NO: 11498 - DNA, 23 bp, Artificial Sequence
  Synthetic
ccgttttttttttttcttaatca

SEQ ID NO: 11499 - DNA, 23 bp, Artificial Sequence
  Synthetic
ccgttttttttttttcttaatca

SEQ ID NO: 11500 - DNA, 23 bp, Artificial Sequence
  Synthetic
ccgttttttttttttcttaatca

SEQ ID NO: 11501 - DNA, 23 bp, Artificial Sequence
  Synthetic
ccgttttttttttttctttgcaa

SEQ ID NO: 11502 - DNA, 23 bp, Artificial Sequence
  Synthetic
ccgttttttttttttgcaaagaa

SEQ ID NO: 11503 - DNA, 23 bp, Artificial Sequence
  Synthetic
ccgttttttttttttgcaaagaa

SEQ ID NO: 11504 - DNA, 23 bp, Artificial Sequence
  Synthetic
ccgttttttttttttggaagcct

SEQ ID NO: 11505 - DNA, 23 bp, Artificial Sequence
  Synthetic
ccgttttttttttttggaagcct

SEQ ID NO: 11506 - DNA, 23 bp, Artificial Sequence
  Synthetic
ccgttttttttttttccctaaaa

SEQ ID NO: 11507 - DNA, 23 bp, Artificial Sequence
  Synthetic
ccgttttttttttttccctaaaa

SEQ ID NO: 11508 - DNA, 23 bp, Artificial Sequence
  Synthetic
ccgttttttttttttccctaaaa

SEQ ID NO: 11509 - DNA, 23 bp, Artificial Sequence
  Synthetic
ccgttttttttttttcctaaaaa

SEQ ID NO: 11510 - DNA, 23 bp, Artificial Sequence
  Synthetic
ccgttttttttttttccctaaaa

SEQ ID NO: 11511 - DNA, 23 bp, Artificial Sequence
  Synthetic
ccgttttttttttttccctaaaa

SEQ ID NO: 11512 - DNA, 23 bp, Artificial Sequence
  Synthetic
ccgttttttttttttccctaaaa

SEQ ID NO: 11513 - DNA, 23 bp, Artificial Sequence
  Synthetic
ccgttttttttttttccctaaaa

SEQ ID NO: 11514 - DNA, 23 bp, Artificial Sequence
  Synthetic
ccgttttttttttttccctaaaa

SEQ ID NO: 11515 - DNA, 23 bp, Artificial Sequence
  Synthetic
ccgttttttttttttccctaaaa

SEQ ID NO: 11516 - DNA, 23 bp, Artificial Sequence
  Synthetic
ccgttttttttttttccctaaaa

SEQ ID NO: 11517 - DNA, 23 bp, Artificial Sequence
  Synthetic
ccgttttttttttttccctaaaa

SEQ ID NO: 11518 - DNA, 23 bp, Artificial Sequence
  Synthetic
ccgttttttttttttccctaaaa

SEQ ID NO: 11519 - DNA, 23 bp, Artificial Sequence
  Synthetic
ccgttttttttttttccctaaaa

SEQ ID NO: 11520 - DNA, 23 bp, Artificial Sequence
  Synthetic
ccgttttttttttttccctaaaa

SEQ ID NO: 11521 - DNA, 23 bp, Artificial Sequence
  Synthetic
ccgttttttttttttccctaaaa

SEQ ID NO: 11522 - DNA, 23 bp, Artificial Sequence
  Synthetic
ccgttttttttttttccctaaaa

SEQ ID NO: 11523 - DNA, 23 bp, Artificial Sequence
  Synthetic
ccgttttttttttttccctaaaa

SEQ ID NO: 11524 - DNA, 23 bp, Artificial Sequence
  Synthetic
ccgttttttttttttccctaaaa

SEQ ID NO: 11525 - DNA, 23 bp, Artificial Sequence
  Synthetic
ccgttttttttttttgatgagcc

SEQ ID NO: 11526 - DNA, 23 bp, Artificial Sequence
  Synthetic
ccgttttttttttttgttcaacg

SEQ ID NO: 11527 - DNA, 23 bp, Artificial Sequence
  Synthetic
ccgttttttttttttgttcaaca

SEQ ID NO: 11528 - DNA, 23 bp, Artificial Sequence
  Synthetic
ccgttttttttttttgcttaagc

SEQ ID NO: 11529 - DNA, 23 bp, Artificial Sequence
  Synthetic
ccgttttttttttttgcttaagc

SEQ ID NO: 11530 - DNA, 23 bp, Artificial Sequence
  Synthetic
ccgttttttttttttgcttaagc

SEQ ID NO: 11531 - DNA, 23 bp, Artificial Sequence
  Synthetic
ccgttttttttttttgcttaagc

SEQ ID NO: 11532 - DNA, 23 bp, Artificial Sequence
  Synthetic
ccgttttttttttttgcttaagc

SEQ ID NO: 11533 - DNA, 23 bp, Artificial Sequence
  Synthetic
ccgttttttttttttggaatggg

SEQ ID NO: 11534 - DNA, 23 bp, Artificial Sequence
  Synthetic
ccgttttttttttttcacaagtt

SEQ ID NO: 11535 - DNA, 23 bp, Artificial Sequence
  Synthetic
ccgttttttttttttcttcagtt

SEQ ID NO: 11536 - DNA, 23 bp, Artificial Sequence
  Synthetic
ccgttttttttttttcatagccc

SEQ ID NO: 11537 - DNA, 23 bp, Artificial Sequence
  Synthetic
ccgttttttttttttacaggagt

SEQ ID NO: 11538 - DNA, 23 bp, Artificial Sequence
  Synthetic
ccgttttttttttttgctacctg

SEQ ID NO: 11539 - DNA, 23 bp, Artificial Sequence
  Synthetic
ccgttttttttttttatctgcac

SEQ ID NO: 11540 - DNA, 23 bp, Artificial Sequence
  Synthetic
ccgttttttttttttgatagccc

SEQ ID NO: 11541 - DNA, 23 bp, Artificial Sequence
  Synthetic
ccgttttttttttttggcattca

SEQ ID NO: 11542 - DNA, 23 bp, Artificial Sequence
  Synthetic
ccgttttttttttttcacaagtt

SEQ ID NO: 11543 - DNA, 23 bp, Artificial Sequence
  Synthetic
ccgttttttttttttagccaagc

SEQ ID NO: 11544 - DNA, 23 bp, Artificial Sequence
  Synthetic
ccgttttttttttttaaaagaga

SEQ ID NO: 11545 - DNA, 23 bp, Artificial Sequence
  Synthetic
ccgttttttttttttcagctggt

SEQ ID NO: 11546 - DNA, 23 bp, Artificial Sequence
  Synthetic
ccgttttttttttttcacatagg

SEQ ID NO: 11547 - DNA, 23 bp, Artificial Sequence
  Synthetic
ccgttttttttttttccatcatc

SEQ ID NO: 11548 - DNA, 23 bp, Artificial Sequence
  Synthetic
ccgttttttttttttctaccata

SEQ ID NO: 11549 - DNA, 23 bp, Artificial Sequence
  Synthetic
ccgttttttttttttgagctaca

SEQ ID NO: 11550 - DNA, 23 bp, Artificial Sequence
  Synthetic
ccgttttttttttttctagtaca

SEQ ID NO: 11551 - DNA, 23 bp, Artificial Sequence
  Synthetic
ccgttttttttttttaagggatt

SEQ ID NO: 11552 - DNA, 23 bp, Artificial Sequence
  Synthetic
ccgttttttttttttgcagaagc

SEQ ID NO: 11553 - DNA, 23 bp, Artificial Sequence
  Synthetic
ccgttttttttttttcgaaggca

SEQ ID NO: 11554 - DNA, 23 bp, Artificial Sequence
  Synthetic
ccgttttttttttttcacaaacc

SEQ ID NO: 11555 - DNA, 23 bp, Artificial Sequence
  Synthetic
ccgttttttttttttgtaaacca

SEQ ID NO: 11556 - DNA, 23 bp, Artificial Sequence
  Synthetic
ccgttttttttttttcgccaata

SEQ ID NO: 11557 - DNA, 23 bp, Artificial Sequence
  Synthetic
ccgttttttttttttacaagtgc

SEQ ID NO: 11558 - DNA, 23 bp, Artificial Sequence
  Synthetic
ccgttttttttttttactacctg

SEQ ID NO: 11559 - DNA, 23 bp, Artificial Sequence
  Synthetic
ccgttttttttttttatctgcac

SEQ ID NO: 11560 - DNA, 23 bp, Artificial Sequence
  Synthetic
ccgttttttttttttactcaccg

SEQ ID NO: 11561 - DNA, 23 bp, Artificial Sequence
  Synthetic
ccgttttttttttttggtacaat

SEQ ID NO: 11562 - DNA, 23 bp, Artificial Sequence
  Synthetic
ccgttttttttttttaacccacc

SEQ ID NO: 11563 - DNA, 23 bp, Artificial Sequence
  Synthetic
ccgttttttttttttactcaccg

SEQ ID NO: 11564 - DNA, 23 bp, Artificial Sequence
  Synthetic
ccgttttttttttttcagtgaat

SEQ ID NO: 11565 - DNA, 23 bp, Artificial Sequence
  Synthetic
ccgttttttttttttacccttat

SEQ ID NO: 11566 - DNA, 23 bp, Artificial Sequence
  Synthetic
ccgttttttttttttaagcccaa

SEQ ID NO: 11567 - DNA, 23 bp, Artificial Sequence
  Synthetic
ccgttttttttttttaccctcca

SEQ ID NO: 11568 - DNA, 23 bp, Artificial Sequence
  Synthetic
ccgttttttttttttacctaata

SEQ ID NO: 11569 - DNA, 23 bp, Artificial Sequence
  Synthetic
ccgttttttttttttccacatgg

SEQ ID NO: 11570 - DNA, 23 bp, Artificial Sequence
  Synthetic
ccgttttttttttttcccaacaa

SEQ ID NO: 11571 - DNA, 23 bp, Artificial Sequence
  Synthetic
ccgttttttttttttgctgggtg

SEQ ID NO: 11572 - DNA, 23 bp, Artificial Sequence
  Synthetic
ccgttttttttttttcctatctc

SEQ ID NO: 11573 - DNA, 23 bp, Artificial Sequence
  Synthetic
ccgttttttttttttgaacaggt

SEQ ID NO: 11574 - DNA, 23 bp, Artificial Sequence
  Synthetic
ccgttttttttttttcagttttg

SEQ ID NO: 11575 - DNA, 23 bp, Artificial Sequence
  Synthetic
ccgttttttttttttcagttttg

SEQ ID NO: 11576 - DNA, 23 bp, Artificial Sequence
  Synthetic
ccgttttttttttttacctgcac

SEQ ID NO: 11577 - DNA, 23 bp, Artificial Sequence
  Synthetic
ccgttttttttttttaggcatag

SEQ ID NO: 11578 - DNA, 23 bp, Artificial Sequence
  Synthetic
ccgttttttttttttcagactcc

SEQ ID NO: 11579 - DNA, 23 bp, Artificial Sequence
  Synthetic
ccgttttttttttttcaacatca

SEQ ID NO: 11580 - DNA, 23 bp, Artificial Sequence
  Synthetic
ccgttttttttttttctgcctgt

SEQ ID NO: 11581 - DNA, 23 bp, Artificial Sequence
  Synthetic
ccgttttttttttttgtctgtca

SEQ ID NO: 11582 - DNA, 23 bp, Artificial Sequence
  Synthetic
ccgttttttttttttcacagttg

SEQ ID NO: 11583 - DNA, 23 bp, Artificial Sequence
  Synthetic
ccgttttttttttttacatggtt

SEQ ID NO: 11584 - DNA, 23 bp, Artificial Sequence
  Synthetic
ccgttttttttttttacagttct

SEQ ID NO: 11585 - DNA, 23 bp, Artificial Sequence
  Synthetic
ccgttttttttttttaaagtgtc

SEQ ID NO: 11586 - DNA, 23 bp, Artificial Sequence
  Synthetic
ccgttttttttttttggggtatt

SEQ ID NO: 11587 - DNA, 23 bp, Artificial Sequence
  Synthetic
ccgttttttttttttaaacggaa

SEQ ID NO: 11588 - DNA, 23 bp, Artificial Sequence
  Synthetic
ccgttttttttttttggaaatcc

SEQ ID NO: 11589 - DNA, 23 bp, Artificial Sequence
  Synthetic
ccgttttttttttttgtggtaat

SEQ ID NO: 11590 - DNA, 23 bp, Artificial Sequence
  Synthetic
ccgttttttttttttctgttcct

SEQ ID NO: 11591 - DNA, 23 bp, Artificial Sequence
  Synthetic
ccgttttttttttttcagaccga

SEQ ID NO: 11592 - DNA, 23 bp, Artificial Sequence
  Synthetic
ccgttttttttttttagcctatc

SEQ ID NO: 11593 - DNA, 23 bp, Artificial Sequence
  Synthetic
ccgttttttttttttggcggaac

SEQ ID NO: 11594 - DNA, 23 bp, Artificial Sequence
  Synthetic
ccgttttttttttttctcaatag

SEQ ID NO: 11595 - DNA, 23 bp, Artificial Sequence
  Synthetic
ccgttttttttttttaaccgatt

SEQ ID NO: 11596 - DNA, 23 bp, Artificial Sequence
  Synthetic
ccgttttttttttttactgattt

SEQ ID NO: 11597 - DNA, 23 bp, Artificial Sequence
  Synthetic
ccgttttttttttttgctgcaaa

SEQ ID NO: 11598 - DNA, 23 bp, Artificial Sequence
  Synthetic
ccgttttttttttttcttccagt

SEQ ID NO: 11599 - DNA, 23 bp, Artificial Sequence
  Synthetic
ccgttttttttttttgctgagtg

SEQ ID NO: 11600 - DNA, 23 bp, Artificial Sequence
  Synthetic
ccgttttttttttttgctgagag

SEQ ID NO: 11601 - DNA, 23 bp, Artificial Sequence
  Synthetic
ccgttttttttttttcttccagt

SEQ ID NO: 11602 - DNA, 23 bp, Artificial Sequence
  Synthetic
ccgttttttttttttcagctatg

SEQ ID NO: 11603 - DNA, 23 bp, Artificial Sequence
  Synthetic
ccgttttttttttttgcaactta

SEQ ID NO: 11604 - DNA, 23 bp, Artificial Sequence
  Synthetic
ccgttttttttttttcaatgcaa

SEQ ID NO: 11605 - DNA, 23 bp, Artificial Sequence
  Synthetic
ccgttttttttttttacaaccag

SEQ ID NO: 11606 - DNA, 23 bp, Artificial Sequence
  Synthetic
ccgttttttttttttaacaaaat

SEQ ID NO: 11607 - DNA, 23 bp, Artificial Sequence
  Synthetic
ccgttttttttttttcatacagc

SEQ ID NO: 11608 - DNA, 23 bp, Artificial Sequence
  Synthetic
ccgttttttttttttacaggccg

SEQ ID NO: 11609 - DNA, 23 bp, Artificial Sequence
  Synthetic
ccgttttttttttttctacctgc

SEQ ID NO: 11610 - DNA, 23 bp, Artificial Sequence
  Synthetic
ccgttttttttttttgctcaata

SEQ ID NO: 11611 - DNA, 23 bp, Artificial Sequence
  Synthetic
ccgttttttttttttgcaaaaat

SEQ ID NO: 11612 - DNA, 23 bp, Artificial Sequence
  Synthetic
ccgttttttttttttaacaatac

SEQ ID NO: 11613 - DNA, 23 bp, Artificial Sequence
  Synthetic
ccgttttttttttttcacaagat

SEQ ID NO: 11614 - DNA, 23 bp, Artificial Sequence
  Synthetic
ccgttttttttttttaaccccgg

SEQ ID NO: 11615 - DNA, 23 bp, Artificial Sequence
  Synthetic
ccgttttttttttttctatcagg

SEQ ID NO: 11616 - DNA, 23 bp, Artificial Sequence
  Synthetic
ccgttttttttttttccccgtat

SEQ ID NO: 11617 - DNA, 23 bp, Artificial Sequence
  Synthetic
ccgttttttttttttctagccag

SEQ ID NO: 11618 - DNA, 23 bp, Artificial Sequence
  Synthetic
ccgttttttttttttcccactgt

SEQ ID NO: 11619 - DNA, 23 bp, Artificial Sequence
  Synthetic
ccgttttttttttttccctggac

SEQ ID NO: 11620 - DNA, 23 bp, Artificial Sequence
  Synthetic
ccgttttttttttttgtcgttca

SEQ ID NO: 11621 - DNA, 23 bp, Artificial Sequence
  Synthetic
ccgttttttttttttatcaagcg

SEQ ID NO: 11622 - DNA, 23 bp, Artificial Sequence
  Synthetic
ccgttttttttttttaaaccaca

SEQ ID NO: 11623 - DNA, 23 bp, Artificial Sequence
  Synthetic
ccgttttttttttttggaacagg

SEQ ID NO: 11624 - DNA, 23 bp, Artificial Sequence
  Synthetic
ccgttttttttttttggaatgaa

SEQ ID NO: 11625 - DNA, 23 bp, Artificial Sequence
  Synthetic
ccgttttttttttttggaaattc

SEQ ID NO: 11626 - DNA, 23 bp, Artificial Sequence
  Synthetic
ccgttttttttttttagcagtag

SEQ ID NO: 11627 - DNA, 23 bp, Artificial Sequence
  Synthetic
ccgttttttttttttagacctag

SEQ ID NO: 11628 - DNA, 23 bp, Artificial Sequence
  Synthetic
ccgttttttttttttaacaccgc

SEQ ID NO: 11629 - DNA, 23 bp, Artificial Sequence
  Synthetic
ccgttttttttttttacacctag

SEQ ID NO: 11630 - DNA, 23 bp, Artificial Sequence
  Synthetic
ccgttttttttttttagcacatc

SEQ ID NO: 11631 - DNA, 23 bp, Artificial Sequence
  Synthetic
ccgttttttttttttgacatagt

SEQ ID NO: 11632 - DNA, 23 bp, Artificial Sequence
  Synthetic
ccgttttttttttttcacagcac

SEQ ID NO: 11633 - DNA, 23 bp, Artificial Sequence
  Synthetic
ccgttttttttttttcagtaagc

SEQ ID NO: 11634 - DNA, 23 bp, Artificial Sequence
  Synthetic
ccgttttttttttttcaatgggc

SEQ ID NO: 11635 - DNA, 23 bp, Artificial Sequence
  Synthetic
ccgttttttttttttactaaggg

SEQ ID NO: 11636 - DNA, 23 bp, Artificial Sequence
  Synthetic
ccgttttttttttttaactatac

SEQ ID NO: 11637 - DNA, 23 bp, Artificial Sequence
  Synthetic
ccgttttttttttttaaccacac

SEQ ID NO: 11638 - DNA, 23 bp, Artificial Sequence
  Synthetic
ccgttttttttttttaaccatac

SEQ ID NO: 11639 - DNA, 23 bp, Artificial Sequence
  Synthetic
ccgttttttttttttactatgca

SEQ ID NO: 11640 - DNA, 23 bp, Artificial Sequence
  Synthetic
ccgttttttttttttagaaaggc

SEQ ID NO: 11641 - DNA, 23 bp, Artificial Sequence
  Synthetic
ccgttttttttttttactataca

SEQ ID NO: 11642 - DNA, 23 bp, Artificial Sequence
  Synthetic
ccgttttttttttttaactatac

SEQ ID NO: 11643 - DNA, 23 bp, Artificial Sequence
  Synthetic
ccgttttttttttttacagcaca

SEQ ID NO: 11644 - DNA, 23 bp, Artificial Sequence
  Synthetic
ccgttttttttttttacacactt

SEQ ID NO: 11645 - DNA, 23 bp, Artificial Sequence
  Synthetic
ccgttttttttttttgggtacat

SEQ ID NO: 11646 - DNA, 23 bp, Artificial Sequence
  Synthetic
ccgttttttttttttcacaagtt

SEQ ID NO: 11647 - DNA, 23 bp, Artificial Sequence
  Synthetic
ccgttttttttttttcttcagtt

SEQ ID NO: 11648 - DNA, 23 bp, Artificial Sequence
  Synthetic
ccgttttttttttttcttcagct

SEQ ID NO: 11649 - DNA, 23 bp, Artificial Sequence
  Synthetic
ccgttttttttttttcatagccc

SEQ ID NO: 11650 - DNA, 23 bp, Artificial Sequence
  Synthetic
ccgttttttttttttatctgcac

SEQ ID NO: 11651 - DNA, 23 bp, Artificial Sequence
  Synthetic
ccgttttttttttttgatagccc

SEQ ID NO: 11652 - DNA, 23 bp, Artificial Sequence
  Synthetic
ccgttttttttttttcacaaatt

SEQ ID NO: 11653 - DNA, 23 bp, Artificial Sequence
  Synthetic
ccgttttttttttttacacaaat

SEQ ID NO: 11654 - DNA, 23 bp, Artificial Sequence
  Synthetic
ccgttttttttttttacaaacac

SEQ ID NO: 11655 - DNA, 23 bp, Artificial Sequence
  Synthetic
ccgttttttttttttggcattca

SEQ ID NO: 11656 - DNA, 23 bp, Artificial Sequence
  Synthetic
ccgttttttttttttcacaggtt

SEQ ID NO: 11657 - DNA, 23 bp, Artificial Sequence
  Synthetic
ccgttttttttttttcacaagtt

SEQ ID NO: 11658 - DNA, 23 bp, Artificial Sequence
  Synthetic
ccgttttttttttttgcattatt

SEQ ID NO: 11659 - DNA, 23 bp, Artificial Sequence
  Synthetic
ccgttttttttttttcgcgtacc

SEQ ID NO: 11660 - DNA, 23 bp, Artificial Sequence
  Synthetic
ccgttttttttttttagccaagc

SEQ ID NO: 11661 - DNA, 23 bp, Artificial Sequence
  Synthetic
ccgttttttttttttaaaagaga

SEQ ID NO: 11662 - DNA, 23 bp, Artificial Sequence
  Synthetic
ccgttttttttttttgaaagaga

SEQ ID NO: 11663 - DNA, 23 bp, Artificial Sequence
  Synthetic
ccgttttttttttttagcaagcc

SEQ ID NO: 11664 - DNA, 23 bp, Artificial Sequence
  Synthetic
ccgttttttttttttatgctttt

SEQ ID NO: 11665 - DNA, 23 bp, Artificial Sequence
  Synthetic
ccgttttttttttttatgccctt

SEQ ID NO: 11666 - DNA, 23 bp, Artificial Sequence
  Synthetic
ccgttttttttttttatgccctt

SEQ ID NO: 11667 - DNA, 23 bp, Artificial Sequence
  Synthetic
ccgttttttttttttcgaccatg

SEQ ID NO: 11668 - DNA, 23 bp, Artificial Sequence
  Synthetic
ccgttttttttttttacagctgg

SEQ ID NO: 11669 - DNA, 23 bp, Artificial Sequence
  Synthetic
ccgttttttttttttagctggtt

SEQ ID NO: 11670 - DNA, 23 bp, Artificial Sequence
  Synthetic
ccgttttttttttttccctctgg

SEQ ID NO: 11671 - DNA, 23 bp, Artificial Sequence
  Synthetic
ccgttttttttttttcacatagg

SEQ ID NO: 11672 - DNA, 23 bp, Artificial Sequence
  Synthetic
ccgttttttttttttcacatagg

SEQ ID NO: 11673 - DNA, 23 bp, Artificial Sequence
  Synthetic
ccgttttttttttttccatcatc

SEQ ID NO: 11674 - DNA, 23 bp, Artificial Sequence
  Synthetic
ccgttttttttttttctacgcgt

SEQ ID NO: 11675 - DNA, 23 bp, Artificial Sequence
  Synthetic
ccgttttttttttttgattcaca

SEQ ID NO: 11676 - DNA, 23 bp, Artificial Sequence
  Synthetic
ccgttttttttttttagacacgt

SEQ ID NO: 11677 - DNA, 23 bp, Artificial Sequence
  Synthetic
ccgttttttttttttctaccata

SEQ ID NO: 11678 - DNA, 23 bp, Artificial Sequence
  Synthetic
ccgttttttttttttgtccgtgg

SEQ ID NO: 11679 - DNA, 23 bp, Artificial Sequence
  Synthetic
ccgttttttttttttccatcttt

SEQ ID NO: 11680 - DNA, 23 bp, Artificial Sequence
  Synthetic
ccgttttttttttttccataaag

SEQ ID NO: 11681 - DNA, 23 bp, Artificial Sequence
  Synthetic
ccgttttttttttttgtagtgct

SEQ ID NO: 11682 - DNA, 23 bp, Artificial Sequence
  Synthetic
ccgttttttttttttgagctaca

SEQ ID NO: 11683 - DNA, 23 bp, Artificial Sequence
  Synthetic
ccgttttttttttttctagtaca

SEQ ID NO: 11684 - DNA, 23 bp, Artificial Sequence
  Synthetic
ccgttttttttttttaagggatt

SEQ ID NO: 11685 - DNA, 23 bp, Artificial Sequence
  Synthetic
ccgttttttttttttaacccatg

SEQ ID NO: 11686 - DNA, 23 bp, Artificial Sequence
  Synthetic
ccgttttttttttttacaaagtt

SEQ ID NO: 11687 - DNA, 23 bp, Artificial Sequence
  Synthetic
ccgttttttttttttcactggta

SEQ ID NO: 11688 - DNA, 23 bp, Artificial Sequence
  Synthetic
ccgttttttttttttcctcaagg

SEQ ID NO: 11689 - DNA, 23 bp, Artificial Sequence
  Synthetic
ccgttttttttttttactagact

SEQ ID NO: 11690 - DNA, 23 bp, Artificial Sequence
  Synthetic
ccgttttttttttttcccaagtt

SEQ ID NO: 11691 - DNA, 23 bp, Artificial Sequence
  Synthetic
ccgttttttttttttcacttttg

SEQ ID NO: 11692 - DNA, 23 bp, Artificial Sequence
  Synthetic
ccgttttttttttttcgaaggca

SEQ ID NO: 11693 - DNA, 23 bp, Artificial Sequence
  Synthetic
ccgttttttttttttgtaaacca

SEQ ID NO: 11694 - DNA, 23 bp, Artificial Sequence
  Synthetic
ccgttttttttttttcgccaata

SEQ ID NO: 11695 - DNA, 23 bp, Artificial Sequence
  Synthetic
ccgttttttttttttactacctg

SEQ ID NO: 11696 - DNA, 23 bp, Artificial Sequence
  Synthetic
ccgttttttttttttatctgcac

SEQ ID NO: 11697 - DNA, 23 bp, Artificial Sequence
  Synthetic
ccgttttttttttttactcaccg

SEQ ID NO: 11698 - DNA, 23 bp, Artificial Sequence
  Synthetic
ccgttttttttttttggtacaat

SEQ ID NO: 11699 - DNA, 23 bp, Artificial Sequence
  Synthetic
ccgttttttttttttcccaccga

SEQ ID NO: 11700 - DNA, 23 bp, Artificial Sequence
  Synthetic
ccgttttttttttttactcaccg

SEQ ID NO: 11701 - DNA, 23 bp, Artificial Sequence
  Synthetic
ccgttttttttttttcagtgaat

SEQ ID NO: 11702 - DNA, 23 bp, Artificial Sequence
  Synthetic
ccgttttttttttttacccttat

SEQ ID NO: 11703 - DNA, 23 bp, Artificial Sequence
  Synthetic
ccgttttttttttttgaactgcc

SEQ ID NO: 11704 - DNA, 23 bp, Artificial Sequence
  Synthetic
ccgttttttttttttaagcccaa

SEQ ID NO: 11705 - DNA, 23 bp, Artificial Sequence
  Synthetic
ccgttttttttttttcggctgca

SEQ ID NO: 11706 - DNA, 23 bp, Artificial Sequence
  Synthetic
ccgttttttttttttactgatat

SEQ ID NO: 11707 - DNA, 23 bp, Artificial Sequence
  Synthetic
ccgttttttttttttacctaata

SEQ ID NO: 11708 - DNA, 23 bp, Artificial Sequence
  Synthetic
ccgttttttttttttagctgctt

SEQ ID NO: 11709 - DNA, 23 bp, Artificial Sequence
  Synthetic
ccgttttttttttttggctgtca

SEQ ID NO: 11710 - DNA, 23 bp, Artificial Sequence
  Synthetic
ccgttttttttttttctgggact

SEQ ID NO: 11711 - DNA, 23 bp, Artificial Sequence
  Synthetic
ccgttttttttttttccacatgg

SEQ ID NO: 11712 - DNA, 23 bp, Artificial Sequence
  Synthetic
ccgttttttttttttgccaatat

SEQ ID NO: 11713 - DNA, 23 bp, Artificial Sequence
  Synthetic
ccgttttttttttttccaacaac

SEQ ID NO: 11714 - DNA, 23 bp, Artificial Sequence
  Synthetic
ccgttttttttttttccaacaac

SEQ ID NO: 11715 - DNA, 23 bp, Artificial Sequence
  Synthetic
ccgttttttttttttgaacaggt

SEQ ID NO: 11716 - DNA, 23 bp, Artificial Sequence
  Synthetic
ccgttttttttttttcagttttg

SEQ ID NO: 11717 - DNA, 23 bp, Artificial Sequence
  Synthetic
ccgttttttttttttcagttttg

SEQ ID NO: 11718 - DNA, 23 bp, Artificial Sequence
  Synthetic
ccgttttttttttttacatcgtt

SEQ ID NO: 11719 - DNA, 23 bp, Artificial Sequence
  Synthetic
ccgttttttttttttgtcatcat

SEQ ID NO: 11720 - DNA, 23 bp, Artificial Sequence
  Synthetic
ccgttttttttttttccatcatt

SEQ ID NO: 11721 - DNA, 23 bp, Artificial Sequence
  Synthetic
ccgttttttttttttctagtggt

SEQ ID NO: 11722 - DNA, 23 bp, Artificial Sequence
  Synthetic
ccgttttttttttttaggcatag

SEQ ID NO: 11723 - DNA, 23 bp, Artificial Sequence
  Synthetic
ccgttttttttttttcagactcc

SEQ ID NO: 11724 - DNA, 23 bp, Artificial Sequence
  Synthetic
ccgttttttttttttccacacac

SEQ ID NO: 11725 - DNA, 23 bp, Artificial Sequence
  Synthetic
ccgttttttttttttaagggagg

SEQ ID NO: 11726 - DNA, 23 bp, Artificial Sequence
  Synthetic
ccgttttttttttttacaagctt

SEQ ID NO: 11727 - DNA, 23 bp, Artificial Sequence
  Synthetic
ccgttttttttttttctacctgc

SEQ ID NO: 11728 - DNA, 23 bp, Artificial Sequence
  Synthetic
ccgttttttttttttgtaagtgc

SEQ ID NO: 11729 - DNA, 23 bp, Artificial Sequence
  Synthetic
ccgttttttttttttacctgcac

SEQ ID NO: 11730 - DNA, 23 bp, Artificial Sequence
  Synthetic
ccgttttttttttttcagaagtg

SEQ ID NO: 11731 - DNA, 23 bp, Artificial Sequence
  Synthetic
ccgttttttttttttcaacatca

SEQ ID NO: 11732 - DNA, 23 bp, Artificial Sequence
  Synthetic
ccgttttttttttttcagccgct

SEQ ID NO: 11733 - DNA, 23 bp, Artificial Sequence
  Synthetic
ccgttttttttttttaggcaaag

SEQ ID NO: 11734 - DNA, 23 bp, Artificial Sequence
  Synthetic
ccgttttttttttttggccgtga

SEQ ID NO: 11735 - DNA, 23 bp, Artificial Sequence
  Synthetic
ccgttttttttttttctgcctgt

SEQ ID NO: 11736 - DNA, 23 bp, Artificial Sequence
  Synthetic
ccgttttttttttttgtctgtca

SEQ ID NO: 11737 - DNA, 23 bp, Artificial Sequence
  Synthetic
ccgttttttttttttcacagttg

SEQ ID NO: 11738 - DNA, 23 bp, Artificial Sequence
  Synthetic
ccgttttttttttttatccagtc

SEQ ID NO: 11739 - DNA, 23 bp, Artificial Sequence
  Synthetic
ccgttttttttttttacatggtt

SEQ ID NO: 11740 - DNA, 23 bp, Artificial Sequence
  Synthetic
ccgttttttttttttagaattgc

SEQ ID NO: 11741 - DNA, 23 bp, Artificial Sequence
  Synthetic
ccgttttttttttttacagttct

SEQ ID NO: 11742 - DNA, 23 bp, Artificial Sequence
  Synthetic
ccgttttttttttttaaagcttg

SEQ ID NO: 11743 - DNA, 23 bp, Artificial Sequence
  Synthetic
ccgttttttttttttgaaaccca

SEQ ID NO: 11744 - DNA, 23 bp, Artificial Sequence
  Synthetic
ccgttttttttttttgagaccca

SEQ ID NO: 11745 - DNA, 23 bp, Artificial Sequence
  Synthetic
ccgttttttttttttggggtatt

SEQ ID NO: 11746 - DNA, 23 bp, Artificial Sequence
  Synthetic
ccgttttttttttttaaacggaa

SEQ ID NO: 11747 - DNA, 23 bp, Artificial Sequence
  Synthetic
ccgttttttttttttggaaatcc

SEQ ID NO: 11748 - DNA, 23 bp, Artificial Sequence
  Synthetic
ccgttttttttttttggtaatcc

SEQ ID NO: 11749 - DNA, 23 bp, Artificial Sequence
  Synthetic
ccgttttttttttttctgttcct

SEQ ID NO: 11750 - DNA, 23 bp, Artificial Sequence
  Synthetic
ccgttttttttttttcagaccga

SEQ ID NO: 11751 - DNA, 23 bp, Artificial Sequence
  Synthetic
ccgttttttttttttgcctatcc

SEQ ID NO: 11752 - DNA, 23 bp, Artificial Sequence
  Synthetic
ccgttttttttttttaacctatc

SEQ ID NO: 11753 - DNA, 23 bp, Artificial Sequence
  Synthetic
ccgttttttttttttgcggaact

SEQ ID NO: 11754 - DNA, 23 bp, Artificial Sequence
  Synthetic
ccgttttttttttttgcagaact

SEQ ID NO: 11755 - DNA, 23 bp, Artificial Sequence
  Synthetic
ccgttttttttttttctcaatag

SEQ ID NO: 11756 - DNA, 23 bp, Artificial Sequence
  Synthetic
ccgttttttttttttaaaaagtg

SEQ ID NO: 11757 - DNA, 23 bp, Artificial Sequence
  Synthetic
ccgttttttttttttggcacaca

SEQ ID NO: 11758 - DNA, 23 bp, Artificial Sequence
  Synthetic
ccgttttttttttttagagaggg

SEQ ID NO: 11759 - DNA, 23 bp, Artificial Sequence
  Synthetic
ccgttttttttttttacactcaa

SEQ ID NO: 11760 - DNA, 23 bp, Artificial Sequence
  Synthetic
ccgttttttttttttcaaaagag

SEQ ID NO: 11761 - DNA, 23 bp, Artificial Sequence
  Synthetic
ccgttttttttttttacaggatt

SEQ ID NO: 11762 - DNA, 23 bp, Artificial Sequence
  Synthetic
ccgttttttttttttcatgcata

SEQ ID NO: 11763 - DNA, 23 bp, Artificial Sequence
  Synthetic
ccgttttttttttttggaagaac

SEQ ID NO: 11764 - DNA, 23 bp, Artificial Sequence
  Synthetic
ccgttttttttttttatgtatgt

SEQ ID NO: 11765 - DNA, 23 bp, Artificial Sequence
  Synthetic
ccgttttttttttttaaccgatt

SEQ ID NO: 11766 - DNA, 23 bp, Artificial Sequence
  Synthetic
ccgttttttttttttaacactga

SEQ ID NO: 11767 - DNA, 23 bp, Artificial Sequence
  Synthetic
ccgttttttttttttaccgattt

SEQ ID NO: 11768 - DNA, 23 bp, Artificial Sequence
  Synthetic
ccgttttttttttttgaacacca

SEQ ID NO: 11769 - DNA, 23 bp, Artificial Sequence
  Synthetic
ccgttttttttttttgaagagag

SEQ ID NO: 11770 - DNA, 23 bp, Artificial Sequence
  Synthetic
ccgttttttttttttatgctttg

SEQ ID NO: 11771 - DNA, 23 bp, Artificial Sequence
  Synthetic
ccgttttttttttttgctgcaaa

SEQ ID NO: 11772 - DNA, 23 bp, Artificial Sequence
  Synthetic
ccgttttttttttttcttccagt

SEQ ID NO: 11773 - DNA, 23 bp, Artificial Sequence
  Synthetic
ccgttttttttttttagctgagt

SEQ ID NO: 11774 - DNA, 23 bp, Artificial Sequence
  Synthetic
ccgttttttttttttgctgagag

SEQ ID NO: 11775 - DNA, 23 bp, Artificial Sequence
  Synthetic
ccgttttttttttttcttccagt

SEQ ID NO: 11776 - DNA, 23 bp, Artificial Sequence
  Synthetic
ccgttttttttttttccagtcaa

SEQ ID NO: 11777 - DNA, 23 bp, Artificial Sequence
  Synthetic
ccgttttttttttttcagctatg

SEQ ID NO: 11778 - DNA, 23 bp, Artificial Sequence
  Synthetic
ccgttttttttttttgcaactta

SEQ ID NO: 11779 - DNA, 23 bp, Artificial Sequence
  Synthetic
ccgttttttttttttcgccctct

SEQ ID NO: 11780 - DNA, 23 bp, Artificial Sequence
  Synthetic
ccgttttttttttttgttgcagc

SEQ ID NO: 11781 - DNA, 23 bp, Artificial Sequence
  Synthetic
ccgttttttttttttagaggtcg

SEQ ID NO: 11782 - DNA, 23 bp, Artificial Sequence
  Synthetic
ccgttttttttttttccagcagc

SEQ ID NO: 11783 - DNA, 23 bp, Artificial Sequence
  Synthetic
ccgttttttttttttacaccaat

SEQ ID NO: 11784 - DNA, 23 bp, Artificial Sequence
  Synthetic
ccgttttttttttttacacttac

SEQ ID NO: 11785 - DNA, 23 bp, Artificial Sequence
  Synthetic
ccgttttttttttttactggagg

SEQ ID NO: 11786 - DNA, 23 bp, Artificial Sequence
  Synthetic
ccgttttttttttttaccctcat

SEQ ID NO: 11787 - DNA, 23 bp, Artificial Sequence
  Synthetic
ccgttttttttttttacggaagg

SEQ ID NO: 11788 - DNA, 23 bp, Artificial Sequence
  Synthetic
ccgttttttttttttaaaaaggt

SEQ ID NO: 11789 - DNA, 23 bp, Artificial Sequence
  Synthetic
ccgttttttttttttcaatgcaa

SEQ ID NO: 11790 - DNA, 23 bp, Artificial Sequence
  Synthetic
ccgttttttttttttctctgcag

SEQ ID NO: 11791 - DNA, 23 bp, Artificial Sequence
  Synthetic
ccgttttttttttttctaggata

SEQ ID NO: 11792 - DNA, 23 bp, Artificial Sequence
  Synthetic
ccgttttttttttttaaaagtaa

SEQ ID NO: 11793 - DNA, 23 bp, Artificial Sequence
  Synthetic
ccgttttttttttttacattttt

SEQ ID NO: 11794 - DNA, 23 bp, Artificial Sequence
  Synthetic
ccgttttttttttttagactaga

SEQ ID NO: 11795 - DNA, 23 bp, Artificial Sequence
  Synthetic
ccgttttttttttttaaaggcat

SEQ ID NO: 11796 - DNA, 23 bp, Artificial Sequence
  Synthetic
ccgttttttttttttcaacaaaa

SEQ ID NO: 11797 - DNA, 23 bp, Artificial Sequence
  Synthetic
ccgttttttttttttgagctcct

SEQ ID NO: 11798 - DNA, 23 bp, Artificial Sequence
  Synthetic
ccgttttttttttttggctataa

SEQ ID NO: 11799 - DNA, 23 bp, Artificial Sequence
  Synthetic
ccgttttttttttttactgaccg

SEQ ID NO: 11800 - DNA, 23 bp, Artificial Sequence
  Synthetic
ccgttttttttttttgacgggtg

SEQ ID NO: 11801 - DNA, 23 bp, Artificial Sequence
  Synthetic
ccgttttttttttttctgggcac

SEQ ID NO: 11802 - DNA, 23 bp, Artificial Sequence
  Synthetic
ccgttttttttttttacggtcag

SEQ ID NO: 11803 - DNA, 23 bp, Artificial Sequence
  Synthetic
ccgttttttttttttgcactgga

SEQ ID NO: 11804 - DNA, 23 bp, Artificial Sequence
  Synthetic
ccgttttttttttttagaggcag

SEQ ID NO: 11805 - DNA, 23 bp, Artificial Sequence
  Synthetic
ccgttttttttttttgggcgacc

SEQ ID NO: 11806 - DNA, 23 bp, Artificial Sequence
  Synthetic
ccgttttttttttttagaggtta

SEQ ID NO: 11807 - DNA, 23 bp, Artificial Sequence
  Synthetic
ccgttttttttttttaacaacca

SEQ ID NO: 11808 - DNA, 23 bp, Artificial Sequence
  Synthetic
ccgttttttttttttcaatcagc

SEQ ID NO: 11809 - DNA, 23 bp, Artificial Sequence
  Synthetic
ccgttttttttttttgcaatcag

SEQ ID NO: 11810 - DNA, 23 bp, Artificial Sequence
  Synthetic
ccgttttttttttttgtgaaagt

SEQ ID NO: 11811 - DNA, 23 bp, Artificial Sequence
  Synthetic
ccgttttttttttttcaggctca

SEQ ID NO: 11812 - DNA, 23 bp, Artificial Sequence
  Synthetic
ccgttttttttttttactatgca

SEQ ID NO: 11813 - DNA, 23 bp, Artificial Sequence
  Synthetic
ccgttttttttttttgtacccct

SEQ ID NO: 11814 - DNA, 23 bp, Artificial Sequence
  Synthetic
ccgttttttttttttacagatgg

SEQ ID NO: 11815 - DNA, 23 bp, Artificial Sequence
  Synthetic
ccgttttttttttttaaattgca

SEQ ID NO: 11816 - DNA, 23 bp, Artificial Sequence
  Synthetic
ccgttttttttttttataaggat

SEQ ID NO: 11817 - DNA, 23 bp, Artificial Sequence
  Synthetic
ccgttttttttttttaagatcaa

SEQ ID NO: 11818 - DNA, 23 bp, Artificial Sequence
  Synthetic
ccgttttttttttttcgaatata

SEQ ID NO: 11819 - DNA, 23 bp, Artificial Sequence
  Synthetic
ccgttttttttttttaaccaggt

SEQ ID NO: 11820 - DNA, 23 bp, Artificial Sequence
  Synthetic
ccgttttttttttttcacttagc

SEQ ID NO: 11821 - DNA, 23 bp, Artificial Sequence
  Synthetic
ccgttttttttttttcgtggatt

SEQ ID NO: 11822 - DNA, 23 bp, Artificial Sequence
  Synthetic
ccgttttttttttttctcataga

SEQ ID NO: 11823 - DNA, 23 bp, Artificial Sequence
  Synthetic
ccgttttttttttttagtggatg

SEQ ID NO: 11824 - DNA, 23 bp, Artificial Sequence
  Synthetic
ccgttttttttttttaaccatag

SEQ ID NO: 11825 - DNA, 23 bp, Artificial Sequence
  Synthetic
ccgttttttttttttcgtgaaat

SEQ ID NO: 11826 - DNA, 23 bp, Artificial Sequence
  Synthetic
ccgttttttttttttccaaaagt

SEQ ID NO: 11827 - DNA, 23 bp, Artificial Sequence
  Synthetic
ccgttttttttttttacacagga

SEQ ID NO: 11828 - DNA, 23 bp, Artificial Sequence
  Synthetic
ccgttttttttttttacgttcca

SEQ ID NO: 11829 - DNA, 23 bp, Artificial Sequence
  Synthetic
ccgttttttttttttgagagctt

SEQ ID NO: 11830 - DNA, 23 bp, Artificial Sequence
  Synthetic
ccgttttttttttttgaatccac

SEQ ID NO: 11831 - DNA, 23 bp, Artificial Sequence
  Synthetic
ccgttttttttttttaagtgttg

SEQ ID NO: 11832 - DNA, 23 bp, Artificial Sequence
  Synthetic
ccgttttttttttttagccacag

SEQ ID NO: 11833 - DNA, 23 bp, Artificial Sequence
  Synthetic
ccgttttttttttttggggttca

SEQ ID NO: 11834 - DNA, 23 bp, Artificial Sequence
  Synthetic
ccgttttttttttttcaaagttg

SEQ ID NO: 11835 - DNA, 23 bp, Artificial Sequence
  Synthetic
ccgttttttttttttacggctag

SEQ ID NO: 11836 - DNA, 23 bp, Artificial Sequence
  Synthetic
ccgttttttttttttcaacaaac

SEQ ID NO: 11837 - DNA, 23 bp, Artificial Sequence
  Synthetic
ccgttttttttttttgccttctg

SEQ ID NO: 11838 - DNA, 23 bp, Artificial Sequence
  Synthetic
ccgttttttttttttccaaaaca

SEQ ID NO: 11839 - DNA, 23 bp, Artificial Sequence
  Synthetic
ccgttttttttttttacggcatt

SEQ ID NO: 11840 - DNA, 23 bp, Artificial Sequence
  Synthetic
ccgttttttttttttgcatgacg

SEQ ID NO: 11841 - DNA, 23 bp, Artificial Sequence
  Synthetic
ccgttttttttttttacaccgag

SEQ ID NO: 11842 - DNA, 23 bp, Artificial Sequence
  Synthetic
ccgttttttttttttatgggaca

SEQ ID NO: 11843 - DNA, 23 bp, Artificial Sequence
  Synthetic
ccgttttttttttttaccagcta

SEQ ID NO: 11844 - DNA, 23 bp, Artificial Sequence
  Synthetic
ccgttttttttttttcattagga

SEQ ID NO: 11845 - DNA, 23 bp, Artificial Sequence
  Synthetic
ccgttttttttttttaactcagt

SEQ ID NO: 11846 - DNA, 23 bp, Artificial Sequence
  Synthetic
ccgttttttttttttacaagacg

SEQ ID NO: 11847 - DNA, 23 bp, Artificial Sequence
  Synthetic
ccgttttttttttttgaattcat

SEQ ID NO: 11848 - DNA, 23 bp, Artificial Sequence
  Synthetic
ccgttttttttttttagtggatg

SEQ ID NO: 11849 - DNA, 23 bp, Artificial Sequence
  Synthetic
ccgttttttttttttgctgccat

SEQ ID NO: 11850 - DNA, 23 bp, Artificial Sequence
  Synthetic
ccgttttttttttttctggcaca

SEQ ID NO: 11851 - DNA, 23 bp, Artificial Sequence
  Synthetic
ccgttttttttttttaggtttcc

SEQ ID NO: 11852 - DNA, 23 bp, Artificial Sequence
  Synthetic
ccgttttttttttttacaaacca

SEQ ID NO: 11853 - DNA, 23 bp, Artificial Sequence
  Synthetic
ccgttttttttttttaaacatca

SEQ ID NO: 11854 - DNA, 23 bp, Artificial Sequence
  Synthetic
ccgttttttttttttcacccagg

SEQ ID NO: 11855 - DNA, 23 bp, Artificial Sequence
  Synthetic
ccgttttttttttttcagtactg

SEQ ID NO: 11856 - DNA, 23 bp, Artificial Sequence
  Synthetic
ccgttttttttttttggaaacca

SEQ ID NO: 11857 - DNA, 23 bp, Artificial Sequence
  Synthetic
ccgttttttttttttacacacca

SEQ ID NO: 11858 - DNA, 23 bp, Artificial Sequence
  Synthetic
ccgttttttttttttccaggatc

SEQ ID NO: 11859 - DNA, 23 bp, Artificial Sequence
  Synthetic
ccgttttttttttttgtgaccaa

SEQ ID NO: 11860 - DNA, 23 bp, Artificial Sequence
  Synthetic
ccgttttttttttttcagttatc

SEQ ID NO: 11861 - DNA, 23 bp, Artificial Sequence
  Synthetic
ccgttttttttttttcgtgacat

SEQ ID NO: 11862 - DNA, 23 bp, Artificial Sequence
  Synthetic
ccgttttttttttttagaagtgc

SEQ ID NO: 11863 - DNA, 23 bp, Artificial Sequence
  Synthetic
ccgttttttttttttaggctggg

SEQ ID NO: 11864 - DNA, 23 bp, Artificial Sequence
  Synthetic
ccgttttttttttttaacaaaat

SEQ ID NO: 11865 - DNA, 23 bp, Artificial Sequence
  Synthetic
ccgttttttttttttatggcaga

SEQ ID NO: 11866 - DNA, 23 bp, Artificial Sequence
  Synthetic
ccgttttttttttttaacaaaat

SEQ ID NO: 11867 - DNA, 23 bp, Artificial Sequence
  Synthetic
ccgttttttttttttcatacagc

SEQ ID NO: 11868 - DNA, 23 bp, Artificial Sequence
  Synthetic
ccgttttttttttttcaggccgg

SEQ ID NO: 11869 - DNA, 23 bp, Artificial Sequence
  Synthetic
ccgttttttttttttctacctgc

SEQ ID NO: 11870 - DNA, 23 bp, Artificial Sequence
  Synthetic
ccgttttttttttttagcaaaaa

SEQ ID NO: 11871 - DNA, 23 bp, Artificial Sequence
  Synthetic
ccgttttttttttttaacaatac

SEQ ID NO: 11872 - DNA, 23 bp, Artificial Sequence
  Synthetic
ccgttttttttttttcacaagat

SEQ ID NO: 11873 - DNA, 23 bp, Artificial Sequence
  Synthetic
ccgttttttttttttcgcaaggt

SEQ ID NO: 11874 - DNA, 23 bp, Artificial Sequence
  Synthetic
ccgttttttttttttgtgctcac

SEQ ID NO: 11875 - DNA, 23 bp, Artificial Sequence
  Synthetic
ccgttttttttttttgtgctcac

SEQ ID NO: 11876 - DNA, 23 bp, Artificial Sequence
  Synthetic
ccgttttttttttttgtgctcac

SEQ ID NO: 11877 - DNA, 23 bp, Artificial Sequence
  Synthetic
ccgttttttttttttgtgctctc

SEQ ID NO: 11878 - DNA, 23 bp, Artificial Sequence
  Synthetic
ccgttttttttttttgtgctcgc

SEQ ID NO: 11879 - DNA, 23 bp, Artificial Sequence
  Synthetic
ccgttttttttttttcagagctc

SEQ ID NO: 11880 - DNA, 23 bp, Artificial Sequence
  Synthetic
ccgttttttttttttaggagctc

SEQ ID NO: 11881 - DNA, 23 bp, Artificial Sequence
  Synthetic
ccgttttttttttttggcataca

SEQ ID NO: 11882 - DNA, 23 bp, Artificial Sequence
  Synthetic
ccgttttttttttttggcataca

SEQ ID NO: 11883 - DNA, 23 bp, Artificial Sequence
  Synthetic
ccgttttttttttttggcataca

SEQ ID NO: 11884 - DNA, 23 bp, Artificial Sequence
  Synthetic
ccgttttttttttttggcataca

SEQ ID NO: 11885 - DNA, 23 bp, Artificial Sequence
  Synthetic
ccgttttttttttttggcataca

SEQ ID NO: 11886 - DNA, 23 bp, Artificial Sequence
  Synthetic
ccgttttttttttttgcacgtgc

SEQ ID NO: 11887 - DNA, 23 bp, Artificial Sequence
  Synthetic
ccgttttttttttttagcacgtg

SEQ ID NO: 11888 - DNA, 23 bp, Artificial Sequence
  Synthetic
ccgttttttttttttctcacgtg

SEQ ID NO: 11889 - DNA, 23 bp, Artificial Sequence
  Synthetic
ccgttttttttttttgggaatga

SEQ ID NO: 11890 - DNA, 23 bp, Artificial Sequence
  Synthetic
ccgttttttttttttgggaatga

SEQ ID NO: 11891 - DNA, 23 bp, Artificial Sequence
  Synthetic
ccgttttttttttttgggaatga

SEQ ID NO: 11892 - DNA, 23 bp, Artificial Sequence
  Synthetic
ccgttttttttttttgggaatga

SEQ ID NO: 11893 - DNA, 23 bp, Artificial Sequence
  Synthetic
ccgttttttttttttagggattg

SEQ ID NO: 11894 - DNA, 23 bp, Artificial Sequence
  Synthetic
ccgttttttttttttgaggaatg

SEQ ID NO: 11895 - DNA, 23 bp, Artificial Sequence
  Synthetic
ccgttttttttttttagggattg

SEQ ID NO: 11896 - DNA, 23 bp, Artificial Sequence
  Synthetic
ccgttttttttttttagatcatg

SEQ ID NO: 11897 - DNA, 23 bp, Artificial Sequence
  Synthetic
ccgttttttttttttagatcatg

SEQ ID NO: 11898 - DNA, 23 bp, Artificial Sequence
  Synthetic
ccgttttttttttttcagatcat

SEQ ID NO: 11899 - DNA, 23 bp, Artificial Sequence
  Synthetic
ccgttttttttttttcagatcat

SEQ ID NO: 11900 - DNA, 23 bp, Artificial Sequence
  Synthetic
ccgttttttttttttcagatcat

SEQ ID NO: 11901 - DNA, 23 bp, Artificial Sequence
  Synthetic
ccgttttttttttttcagatcat

SEQ ID NO: 11902 - DNA, 23 bp, Artificial Sequence
  Synthetic
ccgttttttttttttcagatcat

SEQ ID NO: 11903 - DNA, 23 bp, Artificial Sequence
  Synthetic
ccgttttttttttttgtcccgat

SEQ ID NO: 11904 - DNA, 23 bp, Artificial Sequence
  Synthetic
ccgttttttttttttcggcaagt

SEQ ID NO: 11905 - DNA, 23 bp, Artificial Sequence
  Synthetic
ccgttttttttttttccggcaag

SEQ ID NO: 11906 - DNA, 23 bp, Artificial Sequence
  Synthetic
ccgttttttttttttaggcaagt

SEQ ID NO: 11907 - DNA, 23 bp, Artificial Sequence
  Synthetic
ccgttttttttttttaggcaagt

SEQ ID NO: 11908 - DNA, 23 bp, Artificial Sequence
  Synthetic
ccgttttttttttttcaggcaag

SEQ ID NO: 11909 - DNA, 23 bp, Artificial Sequence
  Synthetic
ccgttttttttttttcaggcaag

SEQ ID NO: 11910 - DNA, 23 bp, Artificial Sequence
  Synthetic
ccgttttttttttttcaggcaag

SEQ ID NO: 11911 - DNA, 23 bp, Artificial Sequence
  Synthetic
ccgttttttttttttcaggcaag

SEQ ID NO: 11912 - DNA, 23 bp, Artificial Sequence
  Synthetic
ccgttttttttttttaggcaagt

SEQ ID NO: 11913 - DNA, 23 bp, Artificial Sequence
  Synthetic
ccgttttttttttttgatattgg

SEQ ID NO: 11914 - DNA, 23 bp, Artificial Sequence
  Synthetic
ccgttttttttttttgatattgg

SEQ ID NO: 11915 - DNA, 23 bp, Artificial Sequence
  Synthetic
ccgttttttttttttgatattgg

SEQ ID NO: 11916 - DNA, 23 bp, Artificial Sequence
  Synthetic
ccgttttttttttttgatattgg

SEQ ID NO: 11917 - DNA, 23 bp, Artificial Sequence
  Synthetic
ccgttttttttttttagtgatat

SEQ ID NO: 11918 - DNA, 23 bp, Artificial Sequence
  Synthetic
ccgttttttttttttagtgatat

SEQ ID NO: 11919 - DNA, 23 bp, Artificial Sequence
  Synthetic
ccgttttttttttttgcagcatc

SEQ ID NO: 11920 - DNA, 23 bp, Artificial Sequence
  Synthetic
ccgttttttttttttgcagcatc

SEQ ID NO: 11921 - DNA, 23 bp, Artificial Sequence
  Synthetic
ccgttttttttttttgcagcatc

SEQ ID NO: 11922 - DNA, 23 bp, Artificial Sequence
  Synthetic
ccgttttttttttttgcagcatc

SEQ ID NO: 11923 - DNA, 23 bp, Artificial Sequence
  Synthetic
ccgttttttttttttgtgcagca

SEQ ID NO: 11924 - DNA, 23 bp, Artificial Sequence
  Synthetic
ccgttttttttttttgggagcac

SEQ ID NO: 11925 - DNA, 23 bp, Artificial Sequence
  Synthetic
ccgttttttttttttgatcaatg

SEQ ID NO: 11926 - DNA, 23 bp, Artificial Sequence
  Synthetic
ccgttttttttttttggaggtgg

SEQ ID NO: 11927 - DNA, 23 bp, Artificial Sequence
  Synthetic
ccgttttttttttttggaggtgg

SEQ ID NO: 11928 - DNA, 23 bp, Artificial Sequence
  Synthetic
ccgttttttttttttgagttccc

SEQ ID NO: 11929 - DNA, 23 bp, Artificial Sequence
  Synthetic
ccgttttttttttttgagttccc

SEQ ID NO: 11930 - DNA, 23 bp, Artificial Sequence
  Synthetic
ccgttttttttttttgagttccc

SEQ ID NO: 11931 - DNA, 23 bp, Artificial Sequence
  Synthetic
ccgttttttttttttgagttccc

SEQ ID NO: 11932 - DNA, 23 bp, Artificial Sequence
  Synthetic
ccgttttttttttttgagttccc

SEQ ID NO: 11933 - DNA, 23 bp, Artificial Sequence
  Synthetic
ccgttttttttttttgagttccc

SEQ ID NO: 11934 - DNA, 23 bp, Artificial Sequence
  Synthetic
ccgttttttttttttcagttcaa

SEQ ID NO: 11935 - DNA, 23 bp, Artificial Sequence
  Synthetic
ccgttttttttttttcagttcaa

SEQ ID NO: 11936 - DNA, 23 bp, Artificial Sequence
  Synthetic
ccgttttttttttttaagttcaa

SEQ ID NO: 11937 - DNA, 23 bp, Artificial Sequence
  Synthetic
ccgttttttttttttcagggcaa

SEQ ID NO: 11938 - DNA, 23 bp, Artificial Sequence
  Synthetic
ccgttttttttttttcagggcag

SEQ ID NO: 11939 - DNA, 23 bp, Artificial Sequence
  Synthetic
ccgttttttttttttcagggcaa

SEQ ID NO: 11940 - DNA, 23 bp, Artificial Sequence
  Synthetic
ccgttttttttttttcagggcaa

SEQ ID NO: 11941 - DNA, 23 bp, Artificial Sequence
  Synthetic
ccgttttttttttttctgggcaa

SEQ ID NO: 11942 - DNA, 23 bp, Artificial Sequence
  Synthetic
ccgttttttttttttctgggcaa

SEQ ID NO: 11943 - DNA, 23 bp, Artificial Sequence
  Synthetic
ccgttttttttttttcggggcaa

SEQ ID NO: 11944 - DNA, 23 bp, Artificial Sequence
  Synthetic
ccgttttttttttttcagggcaa

SEQ ID NO: 11945 - DNA, 23 bp, Artificial Sequence
  Synthetic
ccgttttttttttttcagggcaa

SEQ ID NO: 11946 - DNA, 23 bp, Artificial Sequence
  Synthetic
ccgttttttttttttcacaagtt

SEQ ID NO: 11947 - DNA, 23 bp, Artificial Sequence
  Synthetic
ccgttttttttttttcttcagtt

SEQ ID NO: 11948 - DNA, 23 bp, Artificial Sequence
  Synthetic
ccgttttttttttttacaggagt

SEQ ID NO: 11949 - DNA, 23 bp, Artificial Sequence
  Synthetic
ccgttttttttttttgctacctg

SEQ ID NO: 11950 - DNA, 23 bp, Artificial Sequence
  Synthetic
ccgttttttttttttatctgcac

SEQ ID NO: 11951 - DNA, 23 bp, Artificial Sequence
  Synthetic
ccgttttttttttttcacaaatt

SEQ ID NO: 11952 - DNA, 23 bp, Artificial Sequence
  Synthetic
ccgttttttttttttcacaagtt

SEQ ID NO: 11953 - DNA, 23 bp, Artificial Sequence
  Synthetic
ccgttttttttttttagccaagc

SEQ ID NO: 11954 - DNA, 23 bp, Artificial Sequence
  Synthetic
ccgttttttttttttaaaagaga

SEQ ID NO: 11955 - DNA, 23 bp, Artificial Sequence
  Synthetic
ccgttttttttttttacagctgg

SEQ ID NO: 11956 - DNA, 23 bp, Artificial Sequence
  Synthetic
ccgttttttttttttgcagaagc

SEQ ID NO: 11957 - DNA, 23 bp, Artificial Sequence
  Synthetic
ccgttttttttttttcacaaacc

SEQ ID NO: 11958 - DNA, 23 bp, Artificial Sequence
  Synthetic
ccgttttttttttttcgccaata

SEQ ID NO: 11959 - DNA, 23 bp, Artificial Sequence
  Synthetic
ccgttttttttttttacaagtgc

SEQ ID NO: 11960 - DNA, 23 bp, Artificial Sequence
  Synthetic
ccgttttttttttttactacctg

SEQ ID NO: 11961 - DNA, 23 bp, Artificial Sequence
  Synthetic
ccgttttttttttttatctgcac

SEQ ID NO: 11962 - DNA, 23 bp, Artificial Sequence
  Synthetic
ccgttttttttttttactcaccg

SEQ ID NO: 11963 - DNA, 23 bp, Artificial Sequence
  Synthetic
ccgttttttttttttcagtgaat

SEQ ID NO: 11964 - DNA, 23 bp, Artificial Sequence
  Synthetic
ccgttttttttttttcgagctcc

SEQ ID NO: 11965 - DNA, 23 bp, Artificial Sequence
  Synthetic
ccgttttttttttttgaacaggt

SEQ ID NO: 11966 - DNA, 23 bp, Artificial Sequence
  Synthetic
ccgttttttttttttcagttttg

SEQ ID NO: 11967 - DNA, 23 bp, Artificial Sequence
  Synthetic
ccgttttttttttttcagttttg

SEQ ID NO: 11968 - DNA, 23 bp, Artificial Sequence
  Synthetic
ccgttttttttttttacctgcac

SEQ ID NO: 11969 - DNA, 23 bp, Artificial Sequence
  Synthetic
ccgttttttttttttaggcatag

SEQ ID NO: 11970 - DNA, 23 bp, Artificial Sequence
  Synthetic
ccgttttttttttttctgcctgt

SEQ ID NO: 11971 - DNA, 23 bp, Artificial Sequence
  Synthetic
ccgttttttttttttacatggtt

SEQ ID NO: 11972 - DNA, 23 bp, Artificial Sequence
  Synthetic
ccgttttttttttttacagttct

SEQ ID NO: 11973 - DNA, 23 bp, Artificial Sequence
  Synthetic
ccgttttttttttttggggtatt

SEQ ID NO: 11974 - DNA, 23 bp, Artificial Sequence
  Synthetic
ccgttttttttttttggaaatcc

SEQ ID NO: 11975 - DNA, 23 bp, Artificial Sequence
  Synthetic
ccgttttttttttttggcggaac

SEQ ID NO: 11976 - DNA, 23 bp, Artificial Sequence
  Synthetic
ccgttttttttttttctcaatag

SEQ ID NO: 11977 - DNA, 23 bp, Artificial Sequence
  Synthetic
ccgttttttttttttaaccgatt

SEQ ID NO: 11978 - DNA, 23 bp, Artificial Sequence
  Synthetic
ccgttttttttttttactgattt

SEQ ID NO: 11979 - DNA, 23 bp, Artificial Sequence
  Synthetic
ccgttttttttttttgcaactta

SEQ ID NO: 11980 - DNA, 23 bp, Artificial Sequence
  Synthetic
ccgttttttttttttacaaccag

SEQ ID NO: 11981 - DNA, 23 bp, Artificial Sequence
  Synthetic
ccgttttttttttttaacaaaat

SEQ ID NO: 11982 - DNA, 23 bp, Artificial Sequence
  Synthetic
ccgttttttttttttacaggccg

SEQ ID NO: 11983 - DNA, 23 bp, Artificial Sequence
  Synthetic
ccgttttttttttttctacctgc

SEQ ID NO: 11984 - DNA, 23 bp, Artificial Sequence
  Synthetic
ccgttttttttttttgctcaata

SEQ ID NO: 11985 - DNA, 23 bp, Artificial Sequence
  Synthetic
ccgttttttttttttgcaaaaat

SEQ ID NO: 11986 - DNA, 23 bp, Artificial Sequence
  Synthetic
ccgttttttttttttccagcttt

SEQ ID NO: 11987 - DNA, 23 bp, Artificial Sequence
  Synthetic
ccgttttttttttttatcagctt

SEQ ID NO: 11988 - DNA, 23 bp, Artificial Sequence
  Synthetic
ccgttttttttttttaaaagctt

SEQ ID NO: 11989 - DNA, 23 bp, Artificial Sequence
  Synthetic
ccgttttttttttttagtcatcc

SEQ ID NO: 11990 - DNA, 23 bp, Artificial Sequence
  Synthetic
ccgttttttttttttagtcatcc

SEQ ID NO: 11991 - DNA, 23 bp, Artificial Sequence
  Synthetic
ccgttttttttttttgagaagac

SEQ ID NO: 11992 - DNA, 23 bp, Artificial Sequence
  Synthetic
ccgttttttttttttaacctttt

SEQ ID NO: 11993 - DNA, 23 bp, Artificial Sequence
  Synthetic
ccgttttttttttttacacagtc

SEQ ID NO: 11994 - DNA, 23 bp, Artificial Sequence
  Synthetic
ccgttttttttttttcaaactcg

SEQ ID NO: 11995 - DNA, 23 bp, Artificial Sequence
  Synthetic
ccgttttttttttttcaccttga

SEQ ID NO: 11996 - DNA, 23 bp, Artificial Sequence
  Synthetic
ccgttttttttttttcgactcct

SEQ ID NO: 11997 - DNA, 23 bp, Artificial Sequence
  Synthetic
ccgttttttttttttaagcattc

SEQ ID NO: 11998 - DNA, 23 bp, Artificial Sequence
  Synthetic
ccgttttttttttttcagcattc

SEQ ID NO: 11999 - DNA, 23 bp, Artificial Sequence
  Synthetic
ccgttttttttttttggcattca

SEQ ID NO: 12000 - DNA, 23 bp, Artificial Sequence
  Synthetic
ccgttttttttttttacaaaggt

SEQ ID NO: 12001 - DNA, 23 bp, Artificial Sequence
  Synthetic
ccgttttttttttttatgcagtc

SEQ ID NO: 12002 - DNA, 23 bp, Artificial Sequence
  Synthetic
ccgttttttttttttatcctgat

SEQ ID NO: 12003 - DNA, 23 bp, Artificial Sequence
  Synthetic
ccgttttttttttttaggcatat

SEQ ID NO: 12004 - DNA, 23 bp, Artificial Sequence
  Synthetic
ccgttttttttttttgctcttta

SEQ ID NO: 12005 - DNA, 23 bp, Artificial Sequence
  Synthetic
ccgttttttttttttgctggttg

SEQ ID NO: 12006 - DNA, 23 bp, Artificial Sequence
  Synthetic
ccgttttttttttttccttagca

SEQ ID NO: 12007 - DNA, 23 bp, Artificial Sequence
  Synthetic
ccgttttttttttttcaccaatt

SEQ ID NO: 12008 - DNA, 23 bp, Artificial Sequence
  Synthetic
ccgttttttttttttggatatgc

SEQ ID NO: 12009 - DNA, 23 bp, Artificial Sequence
  Synthetic
ccgttttttttttttcaccaata

SEQ ID NO: 12010 - DNA, 23 bp, Artificial Sequence
  Synthetic
ccgttttttttttttacacgata

SEQ ID NO: 12011 - DNA, 23 bp, Artificial Sequence
  Synthetic
ccgttttttttttttatgcatat

SEQ ID NO: 12012 - DNA, 23 bp, Artificial Sequence
  Synthetic
ccgttttttttttttgaccataa

SEQ ID NO: 12013 - DNA, 23 bp, Artificial Sequence
  Synthetic
ccgttttttttttttgacactat

SEQ ID NO: 12014 - DNA, 23 bp, Artificial Sequence
  Synthetic
ccgttttttttttttgagaactg

SEQ ID NO: 12015 - DNA, 23 bp, Artificial Sequence
  Synthetic
ccgttttttttttttgtcatatc

SEQ ID NO: 12016 - DNA, 23 bp, Artificial Sequence
  Synthetic
ccgttttttttttttcttggcca

SEQ ID NO: 12017 - DNA, 23 bp, Artificial Sequence
  Synthetic
ccgttttttttttttgaagctgc

SEQ ID NO: 12018 - DNA, 23 bp, Artificial Sequence
  Synthetic
ccgttttttttttttatcatacc

SEQ ID NO: 12019 - DNA, 23 bp, Artificial Sequence
  Synthetic
ccgttttttttttttcttggcca

SEQ ID NO: 12020 - DNA, 23 bp, Artificial Sequence
  Synthetic
ccgttttttttttttcgaatgtt

SEQ ID NO: 12021 - DNA, 23 bp, Artificial Sequence
  Synthetic
ccgttttttttttttgaagagca

SEQ ID NO: 12022 - DNA, 23 bp, Artificial Sequence
  Synthetic
ccgttttttttttttacctcatg

SEQ ID NO: 12023 - DNA, 23 bp, Artificial Sequence
  Synthetic
ccgttttttttttttagcgttcc

SEQ ID NO: 12024 - DNA, 23 bp, Artificial Sequence
  Synthetic
ccgttttttttttttatatcaca

SEQ ID NO: 12025 - DNA, 23 bp, Artificial Sequence
  Synthetic
ccgttttttttttttatctcatc

SEQ ID NO: 12026 - DNA, 23 bp, Artificial Sequence
  Synthetic
ccgttttttttttttctgacaac

SEQ ID NO: 12027 - DNA, 23 bp, Artificial Sequence
  Synthetic
ccgttttttttttttagatcatc

SEQ ID NO: 12028 - DNA, 23 bp, Artificial Sequence
  Synthetic
ccgttttttttttttggacatca

SEQ ID NO: 12029 - DNA, 23 bp, Artificial Sequence
  Synthetic
ccgttttttttttttcagttatg

SEQ ID NO: 12030 - DNA, 23 bp, Artificial Sequence
  Synthetic
ccgttttttttttttcagctatg

SEQ ID NO: 12031 - DNA, 23 bp, Artificial Sequence
  Synthetic
ccgttttttttttttaatgaatg

SEQ ID NO: 12032 - DNA, 23 bp, Artificial Sequence
  Synthetic
ccgttttttttttttaaaccaag

SEQ ID NO: 12033 - DNA, 23 bp, Artificial Sequence
  Synthetic
ccgttttttttttttacagtaag

SEQ ID NO: 12034 - DNA, 23 bp, Artificial Sequence
  Synthetic
ccgttttttttttttaccctcgt

SEQ ID NO: 12035 - DNA, 23 bp, Artificial Sequence
  Synthetic
ccgttttttttttttatctcact

SEQ ID NO: 12036 - DNA, 23 bp, Artificial Sequence
  Synthetic
ccgttttttttttttgtcccact

SEQ ID NO: 12037 - DNA, 23 bp, Artificial Sequence
  Synthetic
ccgttttttttttttcgaaaaac

SEQ ID NO: 12038 - DNA, 23 bp, Artificial Sequence
  Synthetic
ccgttttttttttttatctcact

SEQ ID NO: 12039 - DNA, 23 bp, Artificial Sequence
  Synthetic
ccgttttttttttttacacagct

SEQ ID NO: 12040 - DNA, 23 bp, Artificial Sequence
  Synthetic
ccgttttttttttttatcccgat

SEQ ID NO: 12041 - DNA, 23 bp, Artificial Sequence
  Synthetic
ccgttttttttttttacttcaat

SEQ ID NO: 12042 - DNA, 23 bp, Artificial Sequence
  Synthetic
ccgttttttttttttctcattac

SEQ ID NO: 12043 - DNA, 23 bp, Artificial Sequence
  Synthetic
ccgttttttttttttaccaccga

SEQ ID NO: 12044 - DNA, 23 bp, Artificial Sequence
  Synthetic
ccgttttttttttttagaactgg

SEQ ID NO: 12045 - DNA, 23 bp, Artificial Sequence
  Synthetic
ccgttttttttttttgtcatggc

SEQ ID NO: 12046 - DNA, 23 bp, Artificial Sequence
  Synthetic
ccgttttttttttttaaaccacc

SEQ ID NO: 12047 - DNA, 23 bp, Artificial Sequence
  Synthetic
ccgttttttttttttgagatcac

SEQ ID NO: 12048 - DNA, 23 bp, Artificial Sequence
  Synthetic
ccgttttttttttttagtaataa

SEQ ID NO: 12049 - DNA, 23 bp, Artificial Sequence
  Synthetic
ccgttttttttttttggtgaaat

SEQ ID NO: 12050 - DNA, 23 bp, Artificial Sequence
  Synthetic
ccgttttttttttttcatccaaa

SEQ ID NO: 12051 - DNA, 23 bp, Artificial Sequence
  Synthetic
ccgttttttttttttgcactttg

SEQ ID NO: 12052 - DNA, 23 bp, Artificial Sequence
  Synthetic
ccgttttttttttttcaactaaa

SEQ ID NO: 12053 - DNA, 23 bp, Artificial Sequence
  Synthetic
ccgttttttttttttacaacgaa

SEQ ID NO: 12054 - DNA, 23 bp, Artificial Sequence
  Synthetic
ccgttttttttttttcagcaaat

SEQ ID NO: 12055 - DNA, 23 bp, Artificial Sequence
  Synthetic
ccgttttttttttttggcatcgt

SEQ ID NO: 12056 - DNA, 23 bp, Artificial Sequence
  Synthetic
ccgttttttttttttacacttga

SEQ ID NO: 12057 - DNA, 23 bp, Artificial Sequence
  Synthetic
ccgttttttttttttctcatttg

SEQ ID NO: 12058 - DNA, 23 bp, Artificial Sequence
  Synthetic
ccgttttttttttttgataatta

SEQ ID NO: 12059 - DNA, 23 bp, Artificial Sequence
  Synthetic
ccgttttttttttttgtgctcac

SEQ ID NO: 12060 - DNA, 23 bp, Artificial Sequence
  Synthetic
ccgttttttttttttcagagctc

SEQ ID NO: 12061 - DNA, 23 bp, Artificial Sequence
  Synthetic
ccgttttttttttttcagagctc

SEQ ID NO: 12062 - DNA, 23 bp, Artificial Sequence
  Synthetic
ccgttttttttttttaggagctc

SEQ ID NO: 12063 - DNA, 23 bp, Artificial Sequence
  Synthetic
ccgttttttttttttcagagctc

SEQ ID NO: 12064 - DNA, 23 bp, Artificial Sequence
  Synthetic
ccgttttttttttttaagagctc

SEQ ID NO: 12065 - DNA, 23 bp, Artificial Sequence
  Synthetic
ccgttttttttttttcagatcat

SEQ ID NO: 12066 - DNA, 23 bp, Artificial Sequence
  Synthetic
ccgttttttttttttcagatcat

SEQ ID NO: 12067 - DNA, 23 bp, Artificial Sequence
  Synthetic
ccgttttttttttttgtcccgat

SEQ ID NO: 12068 - DNA, 23 bp, Artificial Sequence
  Synthetic
ccgttttttttttttgtcccgat

SEQ ID NO: 12069 - DNA, 23 bp, Artificial Sequence
  Synthetic
ccgttttttttttttcagttcaa

SEQ ID NO: 12070 - DNA, 23 bp, Artificial Sequence
  Synthetic
ccgttttttttttttgccaggga

SEQ ID NO: 12071 - DNA, 23 bp, Artificial Sequence
  Synthetic
ccgttttttttttttgccaggga

SEQ ID NO: 12072 - DNA, 23 bp, Artificial Sequence
  Synthetic
ccgttttttttttttgccaggga

SEQ ID NO: 12073 - DNA, 23 bp, Artificial Sequence
  Synthetic
ccgttttttttttttgccaggga

SEQ ID NO: 12074 - DNA, 23 bp, Artificial Sequence
  Synthetic
ccgttttttttttttgccaggga

SEQ ID NO: 12075 - DNA, 23 bp, Artificial Sequence
  Synthetic
ccgttttttttttttaaccatac

SEQ ID NO: 12076 - DNA, 23 bp, Artificial Sequence
  Synthetic
ccgttttttttttttaactatac

SEQ ID NO: 12077 - DNA, 23 bp, Artificial Sequence
  Synthetic
ccgttttttttttttagcacaaa

SEQ ID NO: 12078 - DNA, 23 bp, Artificial Sequence
  Synthetic
ccgttttttttttttcatagccc

SEQ ID NO: 12079 - DNA, 23 bp, Artificial Sequence
  Synthetic
ccgttttttttttttacaggagt

SEQ ID NO: 12080 - DNA, 23 bp, Artificial Sequence
  Synthetic
ccgttttttttttttcaaggagt

SEQ ID NO: 12081 - DNA, 23 bp, Artificial Sequence
  Synthetic
ccgttttttttttttgctacctg

SEQ ID NO: 12082 - DNA, 23 bp, Artificial Sequence
  Synthetic
ccgttttttttttttgatagccc

SEQ ID NO: 12083 - DNA, 23 bp, Artificial Sequence
  Synthetic
ccgttttttttttttacaaacac

SEQ ID NO: 12084 - DNA, 23 bp, Artificial Sequence
  Synthetic
ccgttttttttttttggcattca

SEQ ID NO: 12085 - DNA, 23 bp, Artificial Sequence
  Synthetic
ccgttttttttttttcacaagtt

SEQ ID NO: 12086 - DNA, 23 bp, Artificial Sequence
  Synthetic
ccgttttttttttttaaaagaga

SEQ ID NO: 12087 - DNA, 23 bp, Artificial Sequence
  Synthetic
ccgttttttttttttcacatagg

SEQ ID NO: 12088 - DNA, 23 bp, Artificial Sequence
  Synthetic
ccgttttttttttttccatcatc

SEQ ID NO: 12089 - DNA, 23 bp, Artificial Sequence
  Synthetic
ccgttttttttttttagacacgt

SEQ ID NO: 12090 - DNA, 23 bp, Artificial Sequence
  Synthetic
ccgttttttttttttctaccata

SEQ ID NO: 12091 - DNA, 23 bp, Artificial Sequence
  Synthetic
ccgttttttttttttaagggatt

SEQ ID NO: 12092 - DNA, 23 bp, Artificial Sequence
  Synthetic
ccgttttttttttttacaaagtt

SEQ ID NO: 12093 - DNA, 23 bp, Artificial Sequence
  Synthetic
ccgttttttttttttcacttttg

SEQ ID NO: 12094 - DNA, 23 bp, Artificial Sequence
  Synthetic
ccgttttttttttttgtaaacca

SEQ ID NO: 12095 - DNA, 23 bp, Artificial Sequence
  Synthetic
ccgttttttttttttatctgcac

SEQ ID NO: 12096 - DNA, 23 bp, Artificial Sequence
  Synthetic
ccgttttttttttttaacccacc

SEQ ID NO: 12097 - DNA, 23 bp, Artificial Sequence
  Synthetic
ccgttttttttttttactcaccg

SEQ ID NO: 12098 - DNA, 23 bp, Artificial Sequence
  Synthetic
ccgttttttttttttcagtgaat

SEQ ID NO: 12099 - DNA, 23 bp, Artificial Sequence
  Synthetic
ccgttttttttttttacccttat

SEQ ID NO: 12100 - DNA, 23 bp, Artificial Sequence
  Synthetic
ccgttttttttttttaagcccaa

SEQ ID NO: 12101 - DNA, 23 bp, Artificial Sequence
  Synthetic
ccgttttttttttttccaacaac

SEQ ID NO: 12102 - DNA, 23 bp, Artificial Sequence
  Synthetic
ccgttttttttttttcagttttg

SEQ ID NO: 12103 - DNA, 23 bp, Artificial Sequence
  Synthetic
ccgttttttttttttacctgcac

SEQ ID NO: 12104 - DNA, 23 bp, Artificial Sequence
  Synthetic
ccgttttttttttttaggcatag

SEQ ID NO: 12105 - DNA, 23 bp, Artificial Sequence
  Synthetic
ccgttttttttttttcagactcc

SEQ ID NO: 12106 - DNA, 23 bp, Artificial Sequence
  Synthetic
ccgttttttttttttcaacatca

SEQ ID NO: 12107 - DNA, 23 bp, Artificial Sequence
  Synthetic
ccgttttttttttttctgcctgt

SEQ ID NO: 12108 - DNA, 23 bp, Artificial Sequence
  Synthetic
ccgttttttttttttcacagttg

SEQ ID NO: 12109 - DNA, 23 bp, Artificial Sequence
  Synthetic
ccgttttttttttttatccaatc

SEQ ID NO: 12110 - DNA, 23 bp, Artificial Sequence
  Synthetic
ccgttttttttttttaaacggaa

SEQ ID NO: 12111 - DNA, 23 bp, Artificial Sequence
  Synthetic
ccgttttttttttttggaaatcc

SEQ ID NO: 12112 - DNA, 23 bp, Artificial Sequence
  Synthetic
ccgttttttttttttctgttcct

SEQ ID NO: 12113 - DNA, 23 bp, Artificial Sequence
  Synthetic
ccgttttttttttttagcctatc

SEQ ID NO: 12114 - DNA, 23 bp, Artificial Sequence
  Synthetic
ccgttttttttttttgcggaact

SEQ ID NO: 12115 - DNA, 23 bp, Artificial Sequence
  Synthetic
ccgttttttttttttctcaatag

SEQ ID NO: 12116 - DNA, 23 bp, Artificial Sequence
  Synthetic
ccgttttttttttttactgattt

SEQ ID NO: 12117 - DNA, 23 bp, Artificial Sequence
  Synthetic
ccgttttttttttttaaccgatt

SEQ ID NO: 12118 - DNA, 23 bp, Artificial Sequence
  Synthetic
ccgttttttttttttgctttgac

SEQ ID NO: 12119 - DNA, 23 bp, Artificial Sequence
  Synthetic
ccgttttttttttttgctgagag

SEQ ID NO: 12120 - DNA, 23 bp, Artificial Sequence
  Synthetic
ccgttttttttttttgcaactta

SEQ ID NO: 12121 - DNA, 23 bp, Artificial Sequence
  Synthetic
ccgttttttttttttagaggtcg

SEQ ID NO: 12122 - DNA, 23 bp, Artificial Sequence
  Synthetic
ccgttttttttttttacacttac

SEQ ID NO: 12123 - DNA, 23 bp, Artificial Sequence
  Synthetic
ccgttttttttttttctggagga

SEQ ID NO: 12124 - DNA, 23 bp, Artificial Sequence
  Synthetic
ccgttttttttttttaacaaaat

SEQ ID NO: 12125 - DNA, 23 bp, Artificial Sequence
  Synthetic
ccgttttttttttttcatacagc

SEQ ID NO: 12126 - DNA, 23 bp, Artificial Sequence
  Synthetic
ccgttttttttttttcatacagc

SEQ ID NO: 12127 - DNA, 23 bp, Artificial Sequence
  Synthetic
ccgttttttttttttgctcaata

SEQ ID NO: 12128 - DNA, 23 bp, Artificial Sequence
  Synthetic
ccgttttttttttttactcaggg

SEQ ID NO: 12129 - DNA, 23 bp, Artificial Sequence
  Synthetic
ccgttttttttttttaaggctca

SEQ ID NO: 12130 - DNA, 23 bp, Artificial Sequence
  Synthetic
ccgttttttttttttaactatac

SEQ ID NO: 12131 - DNA, 23 bp, Artificial Sequence
  Synthetic
ccgttttttttttttaaccacac

SEQ ID NO: 12132 - DNA, 23 bp, Artificial Sequence
  Synthetic
ccgttttttttttttaaccatac

SEQ ID NO: 12133 - DNA, 23 bp, Artificial Sequence
  Synthetic
ccgttttttttttttaactattc

SEQ ID NO: 12134 - DNA, 23 bp, Artificial Sequence
  Synthetic
ccgttttttttttttaactatac

SEQ ID NO: 12135 - DNA, 23 bp, Artificial Sequence
  Synthetic
ccgttttttttttttaacaacac

SEQ ID NO: 12136 - DNA, 23 bp, Artificial Sequence
  Synthetic
ccgttttttttttttaacagcac

SEQ ID NO: 12137 - DNA, 23 bp, Artificial Sequence
  Synthetic
ccgttttttttttttaactgtac

SEQ ID NO: 12138 - DNA, 23 bp, Artificial Sequence
  Synthetic
ccgttttttttttttatacatac

SEQ ID NO: 12139 - DNA, 23 bp, Artificial Sequence
  Synthetic
ccgttttttttttttcacaagtt

SEQ ID NO: 12140 - DNA, 23 bp, Artificial Sequence
  Synthetic
ccgttttttttttttcttcagtt

SEQ ID NO: 12141 - DNA, 23 bp, Artificial Sequence
  Synthetic
ccgttttttttttttcttcagtt

SEQ ID NO: 12142 - DNA, 23 bp, Artificial Sequence
  Synthetic
ccgttttttttttttcatagccc

SEQ ID NO: 12143 - DNA, 23 bp, Artificial Sequence
  Synthetic
ccgttttttttttttgatagccc

SEQ ID NO: 12144 - DNA, 23 bp, Artificial Sequence
  Synthetic
ccgttttttttttttcacaaatt

SEQ ID NO: 12145 - DNA, 23 bp, Artificial Sequence
  Synthetic
ccgttttttttttttacaaatcc

SEQ ID NO: 12146 - DNA, 23 bp, Artificial Sequence
  Synthetic
ccgttttttttttttcacacaca

SEQ ID NO: 12147 - DNA, 23 bp, Artificial Sequence
  Synthetic
ccgttttttttttttcaaacacc

SEQ ID NO: 12148 - DNA, 23 bp, Artificial Sequence
  Synthetic
ccgttttttttttttggcattca

SEQ ID NO: 12149 - DNA, 23 bp, Artificial Sequence
  Synthetic
ccgttttttttttttcacaggtt

SEQ ID NO: 12150 - DNA, 23 bp, Artificial Sequence
  Synthetic
ccgttttttttttttcacaagtt

SEQ ID NO: 12151 - DNA, 23 bp, Artificial Sequence
  Synthetic
ccgttttttttttttgcattatt

SEQ ID NO: 12152 - DNA, 23 bp, Artificial Sequence
  Synthetic
ccgttttttttttttaaaagaga

SEQ ID NO: 12153 - DNA, 23 bp, Artificial Sequence
  Synthetic
ccgttttttttttttagcaagcc

SEQ ID NO: 12154 - DNA, 23 bp, Artificial Sequence
  Synthetic
ccgttttttttttttatgccctt

SEQ ID NO: 12155 - DNA, 23 bp, Artificial Sequence
  Synthetic
ccgttttttttttttcgaccatg

SEQ ID NO: 12156 - DNA, 23 bp, Artificial Sequence
  Synthetic
ccgttttttttttttcagctggt

SEQ ID NO: 12157 - DNA, 23 bp, Artificial Sequence
  Synthetic
ccgttttttttttttcacatagg

SEQ ID NO: 12158 - DNA, 23 bp, Artificial Sequence
  Synthetic
ccgttttttttttttcagatagg

SEQ ID NO: 12159 - DNA, 23 bp, Artificial Sequence
  Synthetic
ccgttttttttttttacgcgtat

SEQ ID NO: 12160 - DNA, 23 bp, Artificial Sequence
  Synthetic
ccgttttttttttttggcctgat

SEQ ID NO: 12161 - DNA, 23 bp, Artificial Sequence
  Synthetic
ccgttttttttttttctaccata

SEQ ID NO: 12162 - DNA, 23 bp, Artificial Sequence
  Synthetic
ccgttttttttttttagtagtgc

SEQ ID NO: 12163 - DNA, 23 bp, Artificial Sequence
  Synthetic
ccgttttttttttttagtagtgc

SEQ ID NO: 12164 - DNA, 23 bp, Artificial Sequence
  Synthetic
ccgttttttttttttagtacatc

SEQ ID NO: 12165 - DNA, 23 bp, Artificial Sequence
  Synthetic
ccgttttttttttttacaaagtt

SEQ ID NO: 12166 - DNA, 23 bp, Artificial Sequence
  Synthetic
ccgttttttttttttacaaagtt

SEQ ID NO: 12167 - DNA, 23 bp, Artificial Sequence
  Synthetic
ccgttttttttttttgatcactt

SEQ ID NO: 12168 - DNA, 23 bp, Artificial Sequence
  Synthetic
ccgttttttttttttgctcattt

SEQ ID NO: 12169 - DNA, 23 bp, Artificial Sequence
  Synthetic
ccgttttttttttttcacaaacc

SEQ ID NO: 12170 - DNA, 23 bp, Artificial Sequence
  Synthetic
ccgttttttttttttacaaacca

SEQ ID NO: 12171 - DNA, 23 bp, Artificial Sequence
  Synthetic
ccgttttttttttttctccaata

SEQ ID NO: 12172 - DNA, 23 bp, Artificial Sequence
  Synthetic
ccgttttttttttttacctgcac

SEQ ID NO: 12173 - DNA, 23 bp, Artificial Sequence
  Synthetic
ccgttttttttttttatctgcac

SEQ ID NO: 12174 - DNA, 23 bp, Artificial Sequence
  Synthetic
ccgttttttttttttactcaccg

SEQ ID NO: 12175 - DNA, 23 bp, Artificial Sequence
  Synthetic
ccgttttttttttttggtacaat

SEQ ID NO: 12176 - DNA, 23 bp, Artificial Sequence
  Synthetic
ccgttttttttttttcccaccga

SEQ ID NO: 12177 - DNA, 23 bp, Artificial Sequence
  Synthetic
ccgttttttttttttagttggca

SEQ ID NO: 12178 - DNA, 23 bp, Artificial Sequence
  Synthetic
ccgttttttttttttcagtgaat

SEQ ID NO: 12179 - DNA, 23 bp, Artificial Sequence
  Synthetic
ccgttttttttttttcccttatc

SEQ ID NO: 12180 - DNA, 23 bp, Artificial Sequence
  Synthetic
ccgttttttttttttggctgcaa

SEQ ID NO: 12181 - DNA, 23 bp, Artificial Sequence
  Synthetic
ccgttttttttttttacctaata

SEQ ID NO: 12182 - DNA, 23 bp, Artificial Sequence
  Synthetic
ccgttttttttttttggctgtca

SEQ ID NO: 12183 - DNA, 23 bp, Artificial Sequence
  Synthetic
ccgttttttttttttactgggac

SEQ ID NO: 12184 - DNA, 23 bp, Artificial Sequence
  Synthetic
ccgttttttttttttccacatgg

SEQ ID NO: 12185 - DNA, 23 bp, Artificial Sequence
  Synthetic
ccgttttttttttttcccaacaa

SEQ ID NO: 12186 - DNA, 23 bp, Artificial Sequence
  Synthetic
ccgttttttttttttcccaacaa

SEQ ID NO: 12187 - DNA, 23 bp, Artificial Sequence
  Synthetic
ccgttttttttttttgaacaggt

SEQ ID NO: 12188 - DNA, 23 bp, Artificial Sequence
  Synthetic
ccgttttttttttttcagttttg

SEQ ID NO: 12189 - DNA, 23 bp, Artificial Sequence
  Synthetic
ccgttttttttttttcagttttg

SEQ ID NO: 12190 - DNA, 23 bp, Artificial Sequence
  Synthetic
ccgttttttttttttctacctgc

SEQ ID NO: 12191 - DNA, 23 bp, Artificial Sequence
  Synthetic
ccgttttttttttttacatcgtt

SEQ ID NO: 12192 - DNA, 23 bp, Artificial Sequence
  Synthetic
ccgttttttttttttcatcatta

SEQ ID NO: 12193 - DNA, 23 bp, Artificial Sequence
  Synthetic
ccgttttttttttttcccatgcc

SEQ ID NO: 12194 - DNA, 23 bp, Artificial Sequence
  Synthetic
ccgttttttttttttcaagtggt

SEQ ID NO: 12195 - DNA, 23 bp, Artificial Sequence
  Synthetic
ccgttttttttttttaggcatag

SEQ ID NO: 12196 - DNA, 23 bp, Artificial Sequence
  Synthetic
ccgttttttttttttaggcatag

SEQ ID NO: 12197 - DNA, 23 bp, Artificial Sequence
  Synthetic
ccgttttttttttttcagactcc

SEQ ID NO: 12198 - DNA, 23 bp, Artificial Sequence
  Synthetic
ccgttttttttttttgccaacac

SEQ ID NO: 12199 - DNA, 23 bp, Artificial Sequence
  Synthetic
ccgttttttttttttagccgctg

SEQ ID NO: 12200 - DNA, 23 bp, Artificial Sequence
  Synthetic
ccgttttttttttttagccatga

SEQ ID NO: 12201 - DNA, 23 bp, Artificial Sequence
  Synthetic
ccgttttttttttttctgcctgt

SEQ ID NO: 12202 - DNA, 23 bp, Artificial Sequence
  Synthetic
ccgttttttttttttcacagttg

SEQ ID NO: 12203 - DNA, 23 bp, Artificial Sequence
  Synthetic
ccgttttttttttttcacagttg

SEQ ID NO: 12204 - DNA, 23 bp, Artificial Sequence
  Synthetic
ccgttttttttttttccaatcag

SEQ ID NO: 12205 - DNA, 23 bp, Artificial Sequence
  Synthetic
ccgttttttttttttcacatggt

SEQ ID NO: 12206 - DNA, 23 bp, Artificial Sequence
  Synthetic
ccgttttttttttttgcatggtt

SEQ ID NO: 12207 - DNA, 23 bp, Artificial Sequence
  Synthetic
ccgttttttttttttaagaattg

SEQ ID NO: 12208 - DNA, 23 bp, Artificial Sequence
  Synthetic
ccgttttttttttttgaaaccca

SEQ ID NO: 12209 - DNA, 23 bp, Artificial Sequence
  Synthetic
ccgttttttttttttgagaccca

SEQ ID NO: 12210 - DNA, 23 bp, Artificial Sequence
  Synthetic
ccgttttttttttttggggtatt

SEQ ID NO: 12211 - DNA, 23 bp, Artificial Sequence
  Synthetic
ccgttttttttttttacagttct

SEQ ID NO: 12212 - DNA, 23 bp, Artificial Sequence
  Synthetic
ccgttttttttttttacagctct

SEQ ID NO: 12213 - DNA, 23 bp, Artificial Sequence
  Synthetic
ccgttttttttttttggaaatcc

SEQ ID NO: 12214 - DNA, 23 bp, Artificial Sequence
  Synthetic
ccgttttttttttttggtaatcc

SEQ ID NO: 12215 - DNA, 23 bp, Artificial Sequence
  Synthetic
ccgttttttttttttctgttcct

SEQ ID NO: 12216 - DNA, 23 bp, Artificial Sequence
  Synthetic
ccgttttttttttttcagaccga

SEQ ID NO: 12217 - DNA, 23 bp, Artificial Sequence
  Synthetic
ccgttttttttttttagcctatc

SEQ ID NO: 12218 - DNA, 23 bp, Artificial Sequence
  Synthetic
ccgttttttttttttgcagaact

SEQ ID NO: 12219 - DNA, 23 bp, Artificial Sequence
  Synthetic
ccgttttttttttttgcagaact

SEQ ID NO: 12220 - DNA, 23 bp, Artificial Sequence
  Synthetic
ccgttttttttttttcactgaac

SEQ ID NO: 12221 - DNA, 23 bp, Artificial Sequence
  Synthetic
ccgttttttttttttaaccgatt

SEQ ID NO: 12222 - DNA, 23 bp, Artificial Sequence
  Synthetic
ccgttttttttttttacactgat

SEQ ID NO: 12223 - DNA, 23 bp, Artificial Sequence
  Synthetic
ccgttttttttttttctatgaca

SEQ ID NO: 12224 - DNA, 23 bp, Artificial Sequence
  Synthetic
ccgttttttttttttagctgagt

SEQ ID NO: 12225 - DNA, 23 bp, Artificial Sequence
  Synthetic
ccgttttttttttttccgagagt

SEQ ID NO: 12226 - DNA, 23 bp, Artificial Sequence
  Synthetic
ccgttttttttttttcttccagt

SEQ ID NO: 12227 - DNA, 23 bp, Artificial Sequence
  Synthetic
ccgttttttttttttcaacaaaa

SEQ ID NO: 12228 - DNA, 23 bp, Artificial Sequence
  Synthetic
ccgttttttttttttataaggat

SEQ ID NO: 12229 - DNA, 23 bp, Artificial Sequence
  Synthetic
ccgttttttttttttaacgcgag

SEQ ID NO: 12230 - DNA, 23 bp, Artificial Sequence
  Synthetic
ccgttttttttttttacggcatt

SEQ ID NO: 12231 - DNA, 23 bp, Artificial Sequence
  Synthetic
ccgttttttttttttcgatgtag

SEQ ID NO: 12232 - DNA, 23 bp, Artificial Sequence
  Synthetic
ccgttttttttttttgcagaacc

SEQ ID NO: 12233 - DNA, 23 bp, Artificial Sequence
  Synthetic
ccgttttttttttttcatccaca

SEQ ID NO: 12234 - DNA, 23 bp, Artificial Sequence
  Synthetic
ccgttttttttttttgcagccgt

SEQ ID NO: 12235 - DNA, 23 bp, Artificial Sequence
  Synthetic
ccgttttttttttttacaacaaa

SEQ ID NO: 12236 - DNA, 23 bp, Artificial Sequence
  Synthetic
ccgttttttttttttcatacagc

SEQ ID NO: 12237 - DNA, 23 bp, Artificial Sequence
  Synthetic
ccgttttttttttttacaggccg

SEQ ID NO: 12238 - DNA, 23 bp, Artificial Sequence
  Synthetic
ccgttttttttttttagcaaaaa

SEQ ID NO: 12239 - DNA, 23 bp, Artificial Sequence
  Synthetic
ccgttttttttttttacagctgg

SEQ ID NO: 12240 - DNA, 23 bp, Artificial Sequence
  Synthetic
ccgttttttttttttctaactgc

SEQ ID NO: 12241 - DNA, 23 bp, Artificial Sequence
  Synthetic
ccgttttttttttttcagttttg

SEQ ID NO: 12242 - DNA, 23 bp, Artificial Sequence
  Synthetic
ccgttttttttttttctacctgc

SEQ ID NO: 12243 - DNA, 23 bp, Artificial Sequence
  Synthetic
ccgttttttttttttcgcccaaa

SEQ ID NO: 12244 - DNA, 23 bp, Artificial Sequence
  Synthetic
ccgttttttttttttcaaccgaa

SEQ ID NO: 12245 - DNA, 23 bp, Artificial Sequence
  Synthetic
ccgttttttttttttcggcatta

SEQ ID NO: 12246 - DNA, 23 bp, Artificial Sequence
  Synthetic
ccgttttttttttttaactatac

SEQ ID NO: 12247 - DNA, 23 bp, Artificial Sequence
  Synthetic
ccgttttttttttttaactacac

SEQ ID NO: 12248 - DNA, 23 bp, Artificial Sequence
  Synthetic
ccgttttttttttttaaccatac

SEQ ID NO: 12249 - DNA, 23 bp, Artificial Sequence
  Synthetic
ccgttttttttttttaactaaac

SEQ ID NO: 12250 - DNA, 23 bp, Artificial Sequence
  Synthetic
ccgttttttttttttactataca

SEQ ID NO: 12251 - DNA, 23 bp, Artificial Sequence
  Synthetic
ccgttttttttttttactgtaca

SEQ ID NO: 12252 - DNA, 23 bp, Artificial Sequence
  Synthetic
ccgttttttttttttacagcaca

SEQ ID NO: 12253 - DNA, 23 bp, Artificial Sequence
  Synthetic
ccgttttttttttttcacaagtt

SEQ ID NO: 12254 - DNA, 23 bp, Artificial Sequence
  Synthetic
ccgttttttttttttcttcagtt

SEQ ID NO: 12255 - DNA, 23 bp, Artificial Sequence
  Synthetic
ccgttttttttttttcatagccc

SEQ ID NO: 12256 - DNA, 23 bp, Artificial Sequence
  Synthetic
ccgttttttttttttctacctgc

SEQ ID NO: 12257 - DNA, 23 bp, Artificial Sequence
  Synthetic
ccgttttttttttttgatagccc

SEQ ID NO: 12258 - DNA, 23 bp, Artificial Sequence
  Synthetic
ccgttttttttttttcacaaatt

SEQ ID NO: 12259 - DNA, 23 bp, Artificial Sequence
  Synthetic
ccgttttttttttttacaaattc

SEQ ID NO: 12260 - DNA, 23 bp, Artificial Sequence
  Synthetic
ccgttttttttttttacaaattc

SEQ ID NO: 12261 - DNA, 23 bp, Artificial Sequence
  Synthetic
ccgttttttttttttacaaacac

SEQ ID NO: 12262 - DNA, 23 bp, Artificial Sequence
  Synthetic
ccgttttttttttttggcattca

SEQ ID NO: 12263 - DNA, 23 bp, Artificial Sequence
  Synthetic
ccgttttttttttttcacaggtt

SEQ ID NO: 12264 - DNA, 23 bp, Artificial Sequence
  Synthetic
ccgttttttttttttcacaagtt

SEQ ID NO: 12265 - DNA, 23 bp, Artificial Sequence
  Synthetic
ccgttttttttttttgcattatt

SEQ ID NO: 12266 - DNA, 23 bp, Artificial Sequence
  Synthetic
ccgttttttttttttcgcgtacc

SEQ ID NO: 12267 - DNA, 23 bp, Artificial Sequence
  Synthetic
ccgttttttttttttaaaagaga

SEQ ID NO: 12268 - DNA, 23 bp, Artificial Sequence
  Synthetic
ccgttttttttttttgcaagccc

SEQ ID NO: 12269 - DNA, 23 bp, Artificial Sequence
  Synthetic
ccgttttttttttttatgccctt

SEQ ID NO: 12270 - DNA, 23 bp, Artificial Sequence
  Synthetic
ccgttttttttttttatgccctt

SEQ ID NO: 12271 - DNA, 23 bp, Artificial Sequence
  Synthetic
ccgttttttttttttatgccctt

SEQ ID NO: 12272 - DNA, 23 bp, Artificial Sequence
  Synthetic
ccgttttttttttttcgaccatg

SEQ ID NO: 12273 - DNA, 23 bp, Artificial Sequence
  Synthetic
ccgttttttttttttacagctgg

SEQ ID NO: 12274 - DNA, 23 bp, Artificial Sequence
  Synthetic
ccgttttttttttttagctggtt

SEQ ID NO: 12275 - DNA, 23 bp, Artificial Sequence
  Synthetic
ccgttttttttttttgcagctgg

SEQ ID NO: 12276 - DNA, 23 bp, Artificial Sequence
  Synthetic
ccgttttttttttttgcggctgg

SEQ ID NO: 12277 - DNA, 23 bp, Artificial Sequence
  Synthetic
ccgttttttttttttcacatagg

SEQ ID NO: 12278 - DNA, 23 bp, Artificial Sequence
  Synthetic
ccgttttttttttttctacgcgt

SEQ ID NO: 12279 - DNA, 23 bp, Artificial Sequence
  Synthetic
ccgttttttttttttgattcaca

SEQ ID NO: 12280 - DNA, 23 bp, Artificial Sequence
  Synthetic
ccgttttttttttttagacacat

SEQ ID NO: 12281 - DNA, 23 bp, Artificial Sequence
  Synthetic
ccgttttttttttttctaccata

SEQ ID NO: 12282 - DNA, 23 bp, Artificial Sequence
  Synthetic
ccgttttttttttttccataaag

SEQ ID NO: 12283 - DNA, 23 bp, Artificial Sequence
  Synthetic
ccgttttttttttttgtagtgct

SEQ ID NO: 12284 - DNA, 23 bp, Artificial Sequence
  Synthetic
ccgttttttttttttcgagctac

SEQ ID NO: 12285 - DNA, 23 bp, Artificial Sequence
  Synthetic
ccgttttttttttttagtacatc

SEQ ID NO: 12286 - DNA, 23 bp, Artificial Sequence
  Synthetic
ccgttttttttttttaagggatt

SEQ ID NO: 12287 - DNA, 23 bp, Artificial Sequence
  Synthetic
ccgttttttttttttaacctatg

SEQ ID NO: 12288 - DNA, 23 bp, Artificial Sequence
  Synthetic
ccgttttttttttttacaaagtt

SEQ ID NO: 12289 - DNA, 23 bp, Artificial Sequence
  Synthetic
ccgttttttttttttacaaagtt

SEQ ID NO: 12290 - DNA, 23 bp, Artificial Sequence
  Synthetic
ccgttttttttttttctctggta

SEQ ID NO: 12291 - DNA, 23 bp, Artificial Sequence
  Synthetic
ccgttttttttttttcacttttg

SEQ ID NO: 12292 - DNA, 23 bp, Artificial Sequence
  Synthetic
ccgttttttttttttcccctatc

SEQ ID NO: 12293 - DNA, 23 bp, Artificial Sequence
  Synthetic
ccgttttttttttttcacaaacc

SEQ ID NO: 12294 - DNA, 23 bp, Artificial Sequence
  Synthetic
ccgttttttttttttgcaaatca

SEQ ID NO: 12295 - DNA, 23 bp, Artificial Sequence
  Synthetic
ccgttttttttttttacaaacca

SEQ ID NO: 12296 - DNA, 23 bp, Artificial Sequence
  Synthetic
ccgttttttttttttcaccaata

SEQ ID NO: 12297 - DNA, 23 bp, Artificial Sequence
  Synthetic
ccgttttttttttttacccaata

SEQ ID NO: 12298 - DNA, 23 bp, Artificial Sequence
  Synthetic
ccgttttttttttttctccagta

SEQ ID NO: 12299 - DNA, 23 bp, Artificial Sequence
  Synthetic
ccgttttttttttttacaagtgc

SEQ ID NO: 12300 - DNA, 23 bp, Artificial Sequence
  Synthetic
ccgttttttttttttactacctg

SEQ ID NO: 12301 - DNA, 23 bp, Artificial Sequence
  Synthetic
ccgttttttttttttactcaccg

SEQ ID NO: 12302 - DNA, 23 bp, Artificial Sequence
  Synthetic
ccgttttttttttttgtacagtc

SEQ ID NO: 12303 - DNA, 23 bp, Artificial Sequence
  Synthetic
ccgttttttttttttcccaccga

SEQ ID NO: 12304 - DNA, 23 bp, Artificial Sequence
  Synthetic
ccgttttttttttttgtgagttc

SEQ ID NO: 12305 - DNA, 23 bp, Artificial Sequence
  Synthetic
ccgttttttttttttagttggca

SEQ ID NO: 12306 - DNA, 23 bp, Artificial Sequence
  Synthetic
ccgttttttttttttcagtgaat

SEQ ID NO: 12307 - DNA, 23 bp, Artificial Sequence
  Synthetic
ccgttttttttttttagccttat

SEQ ID NO: 12308 - DNA, 23 bp, Artificial Sequence
  Synthetic
ccgttttttttttttggctgcaa

SEQ ID NO: 12309 - DNA, 23 bp, Artificial Sequence
  Synthetic
ccgttttttttttttactgatat

SEQ ID NO: 12310 - DNA, 23 bp, Artificial Sequence
  Synthetic
ccgttttttttttttatctgcac

SEQ ID NO: 12311 - DNA, 23 bp, Artificial Sequence
  Synthetic
ccgttttttttttttctaactgc

SEQ ID NO: 12312 - DNA, 23 bp, Artificial Sequence
  Synthetic
ccgttttttttttttagctgctt

SEQ ID NO: 12313 - DNA, 23 bp, Artificial Sequence
  Synthetic
ccgttttttttttttggctgtca

SEQ ID NO: 12314 - DNA, 23 bp, Artificial Sequence
  Synthetic
ccgttttttttttttgaagcggg

SEQ ID NO: 12315 - DNA, 23 bp, Artificial Sequence
  Synthetic
ccgttttttttttttccacatgg

SEQ ID NO: 12316 - DNA, 23 bp, Artificial Sequence
  Synthetic
ccgttttttttttttccaacaac

SEQ ID NO: 12317 - DNA, 23 bp, Artificial Sequence
  Synthetic
ccgttttttttttttccaacaac

SEQ ID NO: 12318 - DNA, 23 bp, Artificial Sequence
  Synthetic
ccgttttttttttttgaacaggt

SEQ ID NO: 12319 - DNA, 23 bp, Artificial Sequence
  Synthetic
ccgttttttttttttaaccaatg

SEQ ID NO: 12320 - DNA, 23 bp, Artificial Sequence
  Synthetic
ccgttttttttttttgaacacgt

SEQ ID NO: 12321 - DNA, 23 bp, Artificial Sequence
  Synthetic
ccgttttttttttttcagttttg

SEQ ID NO: 12322 - DNA, 23 bp, Artificial Sequence
  Synthetic
ccgttttttttttttcagttttg

SEQ ID NO: 12323 - DNA, 23 bp, Artificial Sequence
  Synthetic
ccgttttttttttttacatactt

SEQ ID NO: 12324 - DNA, 23 bp, Artificial Sequence
  Synthetic
ccgttttttttttttacatactt

SEQ ID NO: 12325 - DNA, 23 bp, Artificial Sequence
  Synthetic
ccgttttttttttttacatcgtt

SEQ ID NO: 12326 - DNA, 23 bp, Artificial Sequence
  Synthetic
ccgttttttttttttatcatcat

SEQ ID NO: 12327 - DNA, 23 bp, Artificial Sequence
  Synthetic
ccgttttttttttttcccatgcc

SEQ ID NO: 12328 - DNA, 23 bp, Artificial Sequence
  Synthetic
ccgttttttttttttaaagaggt

SEQ ID NO: 12329 - DNA, 23 bp, Artificial Sequence
  Synthetic
ccgttttttttttttcaagtggt

SEQ ID NO: 12330 - DNA, 23 bp, Artificial Sequence
  Synthetic
ccgttttttttttttaggcatag

SEQ ID NO: 12331 - DNA, 23 bp, Artificial Sequence
  Synthetic
ccgttttttttttttcagactcc

SEQ ID NO: 12332 - DNA, 23 bp, Artificial Sequence
  Synthetic
ccgttttttttttttcaggatcc

SEQ ID NO: 12333 - DNA, 23 bp, Artificial Sequence
  Synthetic
ccgttttttttttttccacacac

SEQ ID NO: 12334 - DNA, 23 bp, Artificial Sequence
  Synthetic
ccgttttttttttttacaagctt

SEQ ID NO: 12335 - DNA, 23 bp, Artificial Sequence
  Synthetic
ccgttttttttttttctacctgc

SEQ ID NO: 12336 - DNA, 23 bp, Artificial Sequence
  Synthetic
ccgttttttttttttaagtgctc

SEQ ID NO: 12337 - DNA, 23 bp, Artificial Sequence
  Synthetic
ccgttttttttttttctacctgc

SEQ ID NO: 12338 - DNA, 23 bp, Artificial Sequence
  Synthetic
ccgttttttttttttagccgctg

SEQ ID NO: 12339 - DNA, 23 bp, Artificial Sequence
  Synthetic
ccgttttttttttttagccatga

SEQ ID NO: 12340 - DNA, 23 bp, Artificial Sequence
  Synthetic
ccgttttttttttttctgcctgt

SEQ ID NO: 12341 - DNA, 23 bp, Artificial Sequence
  Synthetic
ccgttttttttttttggctgtca

SEQ ID NO: 12342 - DNA, 23 bp, Artificial Sequence
  Synthetic
ccgttttttttttttcacagttg

SEQ ID NO: 12343 - DNA, 23 bp, Artificial Sequence
  Synthetic
ccgttttttttttttatccaatc

SEQ ID NO: 12344 - DNA, 23 bp, Artificial Sequence
  Synthetic
ccgttttttttttttacatggtt

SEQ ID NO: 12345 - DNA, 23 bp, Artificial Sequence
  Synthetic
ccgttttttttttttagaattgc

SEQ ID NO: 12346 - DNA, 23 bp, Artificial Sequence
  Synthetic
ccgttttttttttttacagttct

SEQ ID NO: 12347 - DNA, 23 bp, Artificial Sequence
  Synthetic
ccgttttttttttttaaagcttg

SEQ ID NO: 12348 - DNA, 23 bp, Artificial Sequence
  Synthetic
ccgttttttttttttgaaaccca

SEQ ID NO: 12349 - DNA, 23 bp, Artificial Sequence
  Synthetic
ccgttttttttttttgagaccca

SEQ ID NO: 12350 - DNA, 23 bp, Artificial Sequence
  Synthetic
ccgttttttttttttggggtatt

SEQ ID NO: 12351 - DNA, 23 bp, Artificial Sequence
  Synthetic
ccgttttttttttttggaaatcc

SEQ ID NO: 12352 - DNA, 23 bp, Artificial Sequence
  Synthetic
ccgttttttttttttggtaatcc

SEQ ID NO: 12353 - DNA, 23 bp, Artificial Sequence
  Synthetic
ccgttttttttttttctgttcct

SEQ ID NO: 12354 - DNA, 23 bp, Artificial Sequence
  Synthetic
ccgttttttttttttctgtcctg

SEQ ID NO: 12355 - DNA, 23 bp, Artificial Sequence
  Synthetic
ccgttttttttttttcagaccga

SEQ ID NO: 12356 - DNA, 23 bp, Artificial Sequence
  Synthetic
ccgttttttttttttgcctatcc

SEQ ID NO: 12357 - DNA, 23 bp, Artificial Sequence
  Synthetic
ccgttttttttttttgcggaact

SEQ ID NO: 12358 - DNA, 23 bp, Artificial Sequence
  Synthetic
ccgttttttttttttgcagaact

SEQ ID NO: 12359 - DNA, 23 bp, Artificial Sequence
  Synthetic
ccgttttttttttttgtggaact

SEQ ID NO: 12360 - DNA, 23 bp, Artificial Sequence
  Synthetic
ccgttttttttttttaaccgatt

SEQ ID NO: 12361 - DNA, 23 bp, Artificial Sequence
  Synthetic
ccgttttttttttttaacactga

SEQ ID NO: 12362 - DNA, 23 bp, Artificial Sequence
  Synthetic
ccgttttttttttttaccgattt

SEQ ID NO: 12363 - DNA, 23 bp, Artificial Sequence
  Synthetic
ccgttttttttttttgaacacca

SEQ ID NO: 12364 - DNA, 23 bp, Artificial Sequence
  Synthetic
ccgttttttttttttgacactga

SEQ ID NO: 12365 - DNA, 23 bp, Artificial Sequence
  Synthetic
ccgttttttttttttgctttgac

SEQ ID NO: 12366 - DNA, 23 bp, Artificial Sequence
  Synthetic
ccgttttttttttttccactaaa

SEQ ID NO: 12367 - DNA, 23 bp, Artificial Sequence
  Synthetic
ccgttttttttttttgctgcaaa

SEQ ID NO: 12368 - DNA, 23 bp, Artificial Sequence
  Synthetic
ccgttttttttttttcttccagt

SEQ ID NO: 12369 - DNA, 23 bp, Artificial Sequence
  Synthetic
ccgttttttttttttagctgagt

SEQ ID NO: 12370 - DNA, 23 bp, Artificial Sequence
  Synthetic
ccgttttttttttttgctgagag

SEQ ID NO: 12371 - DNA, 23 bp, Artificial Sequence
  Synthetic
ccgttttttttttttcttccagt

SEQ ID NO: 12372 - DNA, 23 bp, Artificial Sequence
  Synthetic
ccgttttttttttttccagtcaa

SEQ ID NO: 12373 - DNA, 23 bp, Artificial Sequence
  Synthetic
ccgttttttttttttcagctatg

SEQ ID NO: 12374 - DNA, 23 bp, Artificial Sequence
  Synthetic
ccgttttttttttttcaacaaaa

SEQ ID NO: 12375 - DNA, 23 bp, Artificial Sequence
  Synthetic
ccgttttttttttttcaatgcaa

SEQ ID NO: 12376 - DNA, 23 bp, Artificial Sequence
  Synthetic
ccgttttttttttttcaatgcaa

SEQ ID NO: 12377 - DNA, 23 bp, Artificial Sequence
  Synthetic
ccgttttttttttttaacaacca

SEQ ID NO: 12378 - DNA, 23 bp, Artificial Sequence
  Synthetic
ccgttttttttttttcaatcagc

SEQ ID NO: 12379 - DNA, 23 bp, Artificial Sequence
  Synthetic
ccgttttttttttttacagatgg

SEQ ID NO: 12380 - DNA, 23 bp, Artificial Sequence
  Synthetic
ccgttttttttttttaaattgca

SEQ ID NO: 12381 - DNA, 23 bp, Artificial Sequence
  Synthetic
ccgttttttttttttataaggat

SEQ ID NO: 12382 - DNA, 23 bp, Artificial Sequence
  Synthetic
ccgttttttttttttcaccattg

SEQ ID NO: 12383 - DNA, 23 bp, Artificial Sequence
  Synthetic
ccgttttttttttttagccacaa

SEQ ID NO: 12384 - DNA, 23 bp, Artificial Sequence
  Synthetic
ccgttttttttttttcaacggga

SEQ ID NO: 12385 - DNA, 23 bp, Artificial Sequence
  Synthetic
ccgttttttttttttcaaccgaa

SEQ ID NO: 12386 - DNA, 23 bp, Artificial Sequence
  Synthetic
ccgttttttttttttacggcatt

SEQ ID NO: 12387 - DNA, 23 bp, Artificial Sequence
  Synthetic
ccgttttttttttttaccagcta

SEQ ID NO: 12388 - DNA, 23 bp, Artificial Sequence
  Synthetic
ccgttttttttttttaactcagt

SEQ ID NO: 12389 - DNA, 23 bp, Artificial Sequence
  Synthetic
ccgttttttttttttcgatgtag

SEQ ID NO: 12390 - DNA, 23 bp, Artificial Sequence
  Synthetic
ccgttttttttttttgcagccgt

SEQ ID NO: 12391 - DNA, 23 bp, Artificial Sequence
  Synthetic
ccgttttttttttttctaaacat

SEQ ID NO: 12392 - DNA, 23 bp, Artificial Sequence
  Synthetic
ccgttttttttttttcaacaaaa

SEQ ID NO: 12393 - DNA, 23 bp, Artificial Sequence
  Synthetic
ccgttttttttttttcatacagc

SEQ ID NO: 12394 - DNA, 23 bp, Artificial Sequence
  Synthetic
ccgttttttttttttactttcgg

SEQ ID NO: 12395 - DNA, 23 bp, Artificial Sequence
  Synthetic
ccgttttttttttttcaggccgg

SEQ ID NO: 12396 - DNA, 23 bp, Artificial Sequence
  Synthetic
ccgttttttttttttgaggccgg

SEQ ID NO: 12397 - DNA, 23 bp, Artificial Sequence
  Synthetic
ccgttttttttttttctacctgc

SEQ ID NO: 12398 - DNA, 23 bp, Artificial Sequence
  Synthetic
ccgttttttttttttctacctgc

SEQ ID NO: 12399 - DNA, 23 bp, Artificial Sequence
  Synthetic
ccgttttttttttttagcaaaaa

SEQ ID NO: 12400 - DNA, 23 bp, Artificial Sequence
  Synthetic
ccgttttttttttttaacaatac

SEQ ID NO: 12401 - DNA, 23 bp, Artificial Sequence
  Synthetic
ccgttttttttttttcacaagat

SEQ ID NO: 12402 - DNA, 23 bp, Artificial Sequence
  Synthetic
ccgttttttttttttcatacagc

SEQ ID NO: 12403 - DNA, 23 bp, Artificial Sequence
  Synthetic
ccgttttttttttttactttcgg

SEQ ID NO: 12404 - DNA, 23 bp, Artificial Sequence
  Synthetic
ccgttttttttttttcatacagc

SEQ ID NO: 12405 - DNA, 23 bp, Artificial Sequence
  Synthetic
ccgttttttttttttacgttcgg

SEQ ID NO: 12406 - DNA, 23 bp, Artificial Sequence
  Synthetic
ccgttttttttttttgtgctcac

SEQ ID NO: 12407 - DNA, 23 bp, Artificial Sequence
  Synthetic
ccgttttttttttttgtgctcac

SEQ ID NO: 12408 - DNA, 23 bp, Artificial Sequence
  Synthetic
ccgttttttttttttgtgctcac

SEQ ID NO: 12409 - DNA, 23 bp, Artificial Sequence
  Synthetic
ccgttttttttttttgtgctcac

SEQ ID NO: 12410 - DNA, 23 bp, Artificial Sequence
  Synthetic
ccgttttttttttttgtgctcac

SEQ ID NO: 12411 - DNA, 23 bp, Artificial Sequence
  Synthetic
ccgttttttttttttgtgctcac

SEQ ID NO: 12412 - DNA, 23 bp, Artificial Sequence
  Synthetic
ccgttttttttttttgtgctcac

SEQ ID NO: 12413 - DNA, 23 bp, Artificial Sequence
  Synthetic
ccgttttttttttttgtgctcac

SEQ ID NO: 12414 - DNA, 23 bp, Artificial Sequence
  Synthetic
ccgttttttttttttgtgctcac

SEQ ID NO: 12415 - DNA, 23 bp, Artificial Sequence
  Synthetic
ccgttttttttttttgtgctctc

SEQ ID NO: 12416 - DNA, 23 bp, Artificial Sequence
  Synthetic
ccgttttttttttttgtgctcgc

SEQ ID NO: 12417 - DNA, 23 bp, Artificial Sequence
  Synthetic
ccgttttttttttttcagagctc

SEQ ID NO: 12418 - DNA, 23 bp, Artificial Sequence
  Synthetic
ccgttttttttttttcagagctc

SEQ ID NO: 12419 - DNA, 23 bp, Artificial Sequence
  Synthetic
ccgttttttttttttaggagctc

SEQ ID NO: 12420 - DNA, 23 bp, Artificial Sequence
  Synthetic
ccgttttttttttttaggagctc

SEQ ID NO: 12421 - DNA, 23 bp, Artificial Sequence
  Synthetic
ccgttttttttttttggcataca

SEQ ID NO: 12422 - DNA, 23 bp, Artificial Sequence
  Synthetic
ccgttttttttttttggcataca

SEQ ID NO: 12423 - DNA, 23 bp, Artificial Sequence
  Synthetic
ccgttttttttttttggcataca

SEQ ID NO: 12424 - DNA, 23 bp, Artificial Sequence
  Synthetic
ccgttttttttttttggcataca

SEQ ID NO: 12425 - DNA, 23 bp, Artificial Sequence
  Synthetic
ccgttttttttttttggcataca

SEQ ID NO: 12426 - DNA, 23 bp, Artificial Sequence
  Synthetic
ccgttttttttttttcggcatac

SEQ ID NO: 12427 - DNA, 23 bp, Artificial Sequence
  Synthetic
ccgttttttttttttggatgcag

SEQ ID NO: 12428 - DNA, 23 bp, Artificial Sequence
  Synthetic
ccgttttttttttttgcacgtgc

SEQ ID NO: 12429 - DNA, 23 bp, Artificial Sequence
  Synthetic
ccgttttttttttttgcacgtgc

SEQ ID NO: 12430 - DNA, 23 bp, Artificial Sequence
  Synthetic
ccgttttttttttttgcacgtgc

SEQ ID NO: 12431 - DNA, 23 bp, Artificial Sequence
  Synthetic
ccgttttttttttttgcacgtgc

SEQ ID NO: 12432 - DNA, 23 bp, Artificial Sequence
  Synthetic
ccgttttttttttttggggaatg

SEQ ID NO: 12433 - DNA, 23 bp, Artificial Sequence
  Synthetic
ccgttttttttttttgggaatga

SEQ ID NO: 12434 - DNA, 23 bp, Artificial Sequence
  Synthetic
ccgttttttttttttgggaatga

SEQ ID NO: 12435 - DNA, 23 bp, Artificial Sequence
  Synthetic
ccgttttttttttttgggaatga

SEQ ID NO: 12436 - DNA, 23 bp, Artificial Sequence
  Synthetic
ccgttttttttttttgggaatga

SEQ ID NO: 12437 - DNA, 23 bp, Artificial Sequence
  Synthetic
ccgttttttttttttgggaatga

SEQ ID NO: 12438 - DNA, 23 bp, Artificial Sequence
  Synthetic
ccgttttttttttttgggaatga

SEQ ID NO: 12439 - DNA, 23 bp, Artificial Sequence
  Synthetic
ccgttttttttttttgggaatga

SEQ ID NO: 12440 - DNA, 23 bp, Artificial Sequence
  Synthetic
ccgttttttttttttgggaatga

SEQ ID NO: 12441 - DNA, 23 bp, Artificial Sequence
  Synthetic
ccgttttttttttttagggattg

SEQ ID NO: 12442 - DNA, 23 bp, Artificial Sequence
  Synthetic
ccgttttttttttttagggattg

SEQ ID NO: 12443 - DNA, 23 bp, Artificial Sequence
  Synthetic
ccgttttttttttttgaggaatg

SEQ ID NO: 12444 - DNA, 23 bp, Artificial Sequence
  Synthetic
ccgttttttttttttgaggaatg

SEQ ID NO: 12445 - DNA, 23 bp, Artificial Sequence
  Synthetic
ccgttttttttttttagatcatg

SEQ ID NO: 12446 - DNA, 23 bp, Artificial Sequence
  Synthetic
ccgttttttttttttagatcatg

SEQ ID NO: 12447 - DNA, 23 bp, Artificial Sequence
  Synthetic
ccgttttttttttttagatcatg

SEQ ID NO: 12448 - DNA, 23 bp, Artificial Sequence
  Synthetic
ccgttttttttttttagatcatg

SEQ ID NO: 12449 - DNA, 23 bp, Artificial Sequence
  Synthetic
ccgttttttttttttcagatcat

SEQ ID NO: 12450 - DNA, 23 bp, Artificial Sequence
  Synthetic
ccgttttttttttttcagatcat

SEQ ID NO: 12451 - DNA, 23 bp, Artificial Sequence
  Synthetic
ccgttttttttttttcagatcat

SEQ ID NO: 12452 - DNA, 23 bp, Artificial Sequence
  Synthetic
ccgttttttttttttcagatcat

SEQ ID NO: 12453 - DNA, 23 bp, Artificial Sequence
  Synthetic
ccgttttttttttttcagatcat

SEQ ID NO: 12454 - DNA, 23 bp, Artificial Sequence
  Synthetic
ccgttttttttttttgtcccgat

SEQ ID NO: 12455 - DNA, 23 bp, Artificial Sequence
  Synthetic
ccgttttttttttttgtcccgat

SEQ ID NO: 12456 - DNA, 23 bp, Artificial Sequence
  Synthetic
ccgttttttttttttcggcaagt

SEQ ID NO: 12457 - DNA, 23 bp, Artificial Sequence
  Synthetic
ccgttttttttttttcggcaagt

SEQ ID NO: 12458 - DNA, 23 bp, Artificial Sequence
  Synthetic
ccgttttttttttttccggcaag

SEQ ID NO: 12459 - DNA, 23 bp, Artificial Sequence
  Synthetic
ccgttttttttttttcataggca

SEQ ID NO: 12460 - DNA, 23 bp, Artificial Sequence
  Synthetic
ccgttttttttttttcgtaggca

SEQ ID NO: 12461 - DNA, 23 bp, Artificial Sequence
  Synthetic
ccgttttttttttttaggcaagt

SEQ ID NO: 12462 - DNA, 23 bp, Artificial Sequence
  Synthetic
ccgttttttttttttaggcaagt

SEQ ID NO: 12463 - DNA, 23 bp, Artificial Sequence
  Synthetic
ccgttttttttttttaggcaagt

SEQ ID NO: 12464 - DNA, 23 bp, Artificial Sequence
  Synthetic
ccgttttttttttttcaggcaag

SEQ ID NO: 12465 - DNA, 23 bp, Artificial Sequence
  Synthetic
ccgttttttttttttcaggcaag

SEQ ID NO: 12466 - DNA, 23 bp, Artificial Sequence
  Synthetic
ccgttttttttttttcaggcaag

SEQ ID NO: 12467 - DNA, 23 bp, Artificial Sequence
  Synthetic
ccgttttttttttttatattggc

SEQ ID NO: 12468 - DNA, 23 bp, Artificial Sequence
  Synthetic
ccgttttttttttttgtgatatt

SEQ ID NO: 12469 - DNA, 23 bp, Artificial Sequence
  Synthetic
ccgttttttttttttgatattgg

SEQ ID NO: 12470 - DNA, 23 bp, Artificial Sequence
  Synthetic
ccgttttttttttttgatattgg

SEQ ID NO: 12471 - DNA, 23 bp, Artificial Sequence
  Synthetic
ccgttttttttttttgatattgg

SEQ ID NO: 12472 - DNA, 23 bp, Artificial Sequence
  Synthetic
ccgttttttttttttgtgatatt

SEQ ID NO: 12473 - DNA, 23 bp, Artificial Sequence
  Synthetic
ccgttttttttttttgatattgg

SEQ ID NO: 12474 - DNA, 23 bp, Artificial Sequence
  Synthetic
ccgttttttttttttagtgatat

SEQ ID NO: 12475 - DNA, 23 bp, Artificial Sequence
  Synthetic
ccgttttttttttttgatattgg

SEQ ID NO: 12476 - DNA, 23 bp, Artificial Sequence
  Synthetic
ccgttttttttttttgatattgg

SEQ ID NO: 12477 - DNA, 23 bp, Artificial Sequence
  Synthetic
ccgttttttttttttagtgatat

SEQ ID NO: 12478 - DNA, 23 bp, Artificial Sequence
  Synthetic
ccgttttttttttttgcagcatc

SEQ ID NO: 12479 - DNA, 23 bp, Artificial Sequence
  Synthetic
ccgttttttttttttgcagcatc

SEQ ID NO: 12480 - DNA, 23 bp, Artificial Sequence
  Synthetic
ccgttttttttttttgcagcatc

SEQ ID NO: 12481 - DNA, 23 bp, Artificial Sequence
  Synthetic
ccgttttttttttttgcagcatc

SEQ ID NO: 12482 - DNA, 23 bp, Artificial Sequence
  Synthetic
ccgttttttttttttatgcagca

SEQ ID NO: 12483 - DNA, 23 bp, Artificial Sequence
  Synthetic
ccgttttttttttttgggagcac

SEQ ID NO: 12484 - DNA, 23 bp, Artificial Sequence
  Synthetic
ccgttttttttttttgggagcac

SEQ ID NO: 12485 - DNA, 23 bp, Artificial Sequence
  Synthetic
ccgttttttttttttgggagcac

SEQ ID NO: 12486 - DNA, 23 bp, Artificial Sequence
  Synthetic
ccgttttttttttttgggagcac

SEQ ID NO: 12487 - DNA, 23 bp, Artificial Sequence
  Synthetic
ccgttttttttttttagatcaat

SEQ ID NO: 12488 - DNA, 23 bp, Artificial Sequence
  Synthetic
ccgttttttttttttggaggtgg

SEQ ID NO: 12489 - DNA, 23 bp, Artificial Sequence
  Synthetic
ccgttttttttttttggaggtgg

SEQ ID NO: 12490 - DNA, 23 bp, Artificial Sequence
  Synthetic
ccgttttttttttttgagttccc

SEQ ID NO: 12491 - DNA, 23 bp, Artificial Sequence
  Synthetic
ccgttttttttttttgagttccc

SEQ ID NO: 12492 - DNA, 23 bp, Artificial Sequence
  Synthetic
ccgttttttttttttgagttcct

SEQ ID NO: 12493 - DNA, 23 bp, Artificial Sequence
  Synthetic
ccgttttttttttttcagttcaa

SEQ ID NO: 12494 - DNA, 23 bp, Artificial Sequence
  Synthetic
ccgttttttttttttcagttcaa

SEQ ID NO: 12495 - DNA, 23 bp, Artificial Sequence
  Synthetic
ccgttttttttttttcagggcaa

SEQ ID NO: 12496 - DNA, 23 bp, Artificial Sequence
  Synthetic
ccgttttttttttttcaggacag

SEQ ID NO: 12497 - DNA, 23 bp, Artificial Sequence
  Synthetic
ccgttttttttttttcagggcaa

SEQ ID NO: 12498 - DNA, 23 bp, Artificial Sequence
  Synthetic
ccgttttttttttttcagggcag

SEQ ID NO: 12499 - DNA, 23 bp, Artificial Sequence
  Synthetic
ccgttttttttttttcagggcaa

SEQ ID NO: 12500 - DNA, 23 bp, Artificial Sequence
  Synthetic
ccgttttttttttttcggggcaa

SEQ ID NO: 12501 - DNA, 23 bp, Artificial Sequence
  Synthetic
ccgttttttttttttgccaggga

SEQ ID NO: 12502 - DNA, 23 bp, Artificial Sequence
  Synthetic
ccgttttttttttttatcagctt

SEQ ID NO: 12503 - DNA, 23 bp, Artificial Sequence
  Synthetic
ccgttttttttttttctatacaa

SEQ ID NO: 12504 - DNA, 23 bp, Artificial Sequence
  Synthetic
ccgttttttttttttccatactt

SEQ ID NO: 12505 - DNA, 23 bp, Artificial Sequence
  Synthetic
ccgttttttttttttcaaattcg

SEQ ID NO: 12506 - DNA, 23 bp, Artificial Sequence
  Synthetic
ccgttttttttttttacaagttc

SEQ ID NO: 12507 - DNA, 23 bp, Artificial Sequence
  Synthetic
ccgttttttttttttggcattca

SEQ ID NO: 12508 - DNA, 23 bp, Artificial Sequence
  Synthetic
ccgttttttttttttacaagtta

SEQ ID NO: 12509 - DNA, 23 bp, Artificial Sequence
  Synthetic
ccgttttttttttttcagctggt

SEQ ID NO: 12510 - DNA, 23 bp, Artificial Sequence
  Synthetic
ccgttttttttttttctcgtcaa

SEQ ID NO: 12511 - DNA, 23 bp, Artificial Sequence
  Synthetic
ccgttttttttttttggagagag

SEQ ID NO: 12512 - DNA, 23 bp, Artificial Sequence
  Synthetic
ccgttttttttttttccttatca

SEQ ID NO: 12513 - DNA, 23 bp, Artificial Sequence
  Synthetic
ccgttttttttttttcacagcca

SEQ ID NO: 12514 - DNA, 23 bp, Artificial Sequence
  Synthetic
ccgttttttttttttgccgttgt

SEQ ID NO: 12515 - DNA, 23 bp, Artificial Sequence
  Synthetic
ccgttttttttttttaagaattg

SEQ ID NO: 12516 - DNA, 23 bp, Artificial Sequence
  Synthetic
ccgttttttttttttgaattctt

SEQ ID NO: 12517 - DNA, 23 bp, Artificial Sequence
  Synthetic
ccgttttttttttttgcgcgcta

SEQ ID NO: 12518 - DNA, 23 bp, Artificial Sequence
  Synthetic
ccgttttttttttttgtaggaac

SEQ ID NO: 12519 - DNA, 23 bp, Artificial Sequence
  Synthetic
ccgttttttttttttcgtaccag

SEQ ID NO: 12520 - DNA, 23 bp, Artificial Sequence
  Synthetic
ccgttttttttttttaacggacg

SEQ ID NO: 12521 - DNA, 23 bp, Artificial Sequence
  Synthetic
ccgttttttttttttatgagtgt

SEQ ID NO: 12522 - DNA, 23 bp, Artificial Sequence
  Synthetic
ccgttttttttttttaaagagag

SEQ ID NO: 12523 - DNA, 23 bp, Artificial Sequence
  Synthetic
ccgttttttttttttcagacaaa

SEQ ID NO: 12524 - DNA, 23 bp, Artificial Sequence
  Synthetic
ccgttttttttttttgaattacc

SEQ ID NO: 12525 - DNA, 23 bp, Artificial Sequence
  Synthetic
ccgttttttttttttagagcacc

SEQ ID NO: 12526 - DNA, 23 bp, Artificial Sequence
  Synthetic
ccgttttttttttttcactcaag

SEQ ID NO: 12527 - DNA, 23 bp, Artificial Sequence
  Synthetic
ccgttttttttttttcacagtat

SEQ ID NO: 12528 - DNA, 23 bp, Artificial Sequence
  Synthetic
ccgttttttttttttctttctga

SEQ ID NO: 12529 - DNA, 23 bp, Artificial Sequence
  Synthetic
ccgttttttttttttctgagata

SEQ ID NO: 12530 - DNA, 23 bp, Artificial Sequence
  Synthetic
ccgttttttttttttcaacaaaa

SEQ ID NO: 12531 - DNA, 23 bp, Artificial Sequence
  Synthetic
ccgttttttttttttgctttggt

SEQ ID NO: 12532 - DNA, 23 bp, Artificial Sequence
  Synthetic
ccgttttttttttttacatcttt

SEQ ID NO: 12533 - DNA, 23 bp, Artificial Sequence
  Synthetic
ccgttttttttttttaggccggg

SEQ ID NO: 12534 - DNA, 23 bp, Artificial Sequence
  Synthetic
ccgttttttttttttcaggccgg

SEQ ID NO: 12535 - DNA, 23 bp, Artificial Sequence
  Synthetic
ccgttttttttttttatacagct

SEQ ID NO: 12536 - DNA, 23 bp, Artificial Sequence
  Synthetic
ccgttttttttttttatacagct

SEQ ID NO: 12537 - DNA, 23 bp, Artificial Sequence
  Synthetic
ccgttttttttttttacagctag

SEQ ID NO: 12538 - DNA, 23 bp, Artificial Sequence
  Synthetic
ccgttttttttttttaggataca

SEQ ID NO: 12539 - DNA, 23 bp, Artificial Sequence
  Synthetic
ccgttttttttttttacaagttc

SEQ ID NO: 12540 - DNA, 23 bp, Artificial Sequence
  Synthetic
ccgttttttttttttcagttatc

SEQ ID NO: 12541 - DNA, 23 bp, Artificial Sequence
  Synthetic
ccgttttttttttttatagccct

SEQ ID NO: 12542 - DNA, 23 bp, Artificial Sequence
  Synthetic
ccgttttttttttttctacctgc

SEQ ID NO: 12543 - DNA, 23 bp, Artificial Sequence
  Synthetic
ccgttttttttttttctgcactg

SEQ ID NO: 12544 - DNA, 23 bp, Artificial Sequence
  Synthetic
ccgttttttttttttacaaattc

SEQ ID NO: 12545 - DNA, 23 bp, Artificial Sequence
  Synthetic
ccgttttttttttttgcattcac

SEQ ID NO: 12546 - DNA, 23 bp, Artificial Sequence
  Synthetic
ccgttttttttttttacaagtta

SEQ ID NO: 12547 - DNA, 23 bp, Artificial Sequence
  Synthetic
ccgttttttttttttgccaagct

SEQ ID NO: 12548 - DNA, 23 bp, Artificial Sequence
  Synthetic
ccgttttttttttttaaagagac

SEQ ID NO: 12549 - DNA, 23 bp, Artificial Sequence
  Synthetic
ccgttttttttttttcagctggt

SEQ ID NO: 12550 - DNA, 23 bp, Artificial Sequence
  Synthetic
ccgttttttttttttacatagga

SEQ ID NO: 12551 - DNA, 23 bp, Artificial Sequence
  Synthetic
ccgttttttttttttacaaacca

SEQ ID NO: 12552 - DNA, 23 bp, Artificial Sequence
  Synthetic
ccgttttttttttttaaaccatg

SEQ ID NO: 12553 - DNA, 23 bp, Artificial Sequence
  Synthetic
ccgttttttttttttgccaatat

SEQ ID NO: 12554 - DNA, 23 bp, Artificial Sequence
  Synthetic
ccgttttttttttttcaagtgcc

SEQ ID NO: 12555 - DNA, 23 bp, Artificial Sequence
  Synthetic
ccgttttttttttttctacctgc

SEQ ID NO: 12556 - DNA, 23 bp, Artificial Sequence
  Synthetic
ccgttttttttttttctgcacta

SEQ ID NO: 12557 - DNA, 23 bp, Artificial Sequence
  Synthetic
ccgttttttttttttcacatgga

SEQ ID NO: 12558 - DNA, 23 bp, Artificial Sequence
  Synthetic
ccgttttttttttttccaacaac

SEQ ID NO: 12559 - DNA, 23 bp, Artificial Sequence
  Synthetic
ccgttttttttttttctgggtgg

SEQ ID NO: 12560 - DNA, 23 bp, Artificial Sequence
  Synthetic
ccgttttttttttttctagctcc

SEQ ID NO: 12561 - DNA, 23 bp, Artificial Sequence
  Synthetic
ccgttttttttttttagttttgc

SEQ ID NO: 12562 - DNA, 23 bp, Artificial Sequence
  Synthetic
ccgttttttttttttagttttgc

SEQ ID NO: 12563 - DNA, 23 bp, Artificial Sequence
  Synthetic
ccgttttttttttttcctgcact

SEQ ID NO: 12564 - DNA, 23 bp, Artificial Sequence
  Synthetic
ccgttttttttttttagactccg

SEQ ID NO: 12565 - DNA, 23 bp, Artificial Sequence
  Synthetic
ccgttttttttttttaacatcag

SEQ ID NO: 12566 - DNA, 23 bp, Artificial Sequence
  Synthetic
ccgttttttttttttgcctgtct

SEQ ID NO: 12567 - DNA, 23 bp, Artificial Sequence
  Synthetic
ccgttttttttttttcatggtta

SEQ ID NO: 12568 - DNA, 23 bp, Artificial Sequence
  Synthetic
ccgttttttttttttcagttctt

SEQ ID NO: 12569 - DNA, 23 bp, Artificial Sequence
  Synthetic
ccgttttttttttttagacccag

SEQ ID NO: 12570 - DNA, 23 bp, Artificial Sequence
  Synthetic
ccgttttttttttttgaaatccc

SEQ ID NO: 12571 - DNA, 23 bp, Artificial Sequence
  Synthetic
ccgttttttttttttgcggaact

SEQ ID NO: 12572 - DNA, 23 bp, Artificial Sequence
  Synthetic
ccgttttttttttttcaatagac

SEQ ID NO: 12573 - DNA, 23 bp, Artificial Sequence
  Synthetic
ccgttttttttttttaccgattt

SEQ ID NO: 12574 - DNA, 23 bp, Artificial Sequence
  Synthetic
ccgttttttttttttctgatttc

SEQ ID NO: 12575 - DNA, 23 bp, Artificial Sequence
  Synthetic
ccgttttttttttttctgagtgt

SEQ ID NO: 12576 - DNA, 23 bp, Artificial Sequence
  Synthetic
ccgttttttttttttcaaccagc

SEQ ID NO: 12577 - DNA, 23 bp, Artificial Sequence
  Synthetic
ccgttttttttttttatacagct

SEQ ID NO: 12578 - DNA, 23 bp, Artificial Sequence
  Synthetic
ccgttttttttttttcaggccgg

SEQ ID NO: 12579 - DNA, 23 bp, Artificial Sequence
  Synthetic
ccgttttttttttttacctgcac

SEQ ID NO: 12580 - DNA, 23 bp, Artificial Sequence
  Synthetic
ccgttttttttttttacaataca

SEQ ID NO: 12581 - DNA, 23 bp, Artificial Sequence
  Synthetic
ccgttttttttttttatcagctt

SEQ ID NO: 12582 - DNA, 23 bp, Artificial Sequence
  Synthetic
ccgttttttttttttccatactt

SEQ ID NO: 12583 - DNA, 23 bp, Artificial Sequence
  Synthetic
ccgttttttttttttccagtacc

SEQ ID NO: 12584 - DNA, 23 bp, Artificial Sequence
  Synthetic
ccgttttttttttttggcattca

SEQ ID NO: 12585 - DNA, 23 bp, Artificial Sequence
  Synthetic
ccgttttttttttttacaagtta

SEQ ID NO: 12586 - DNA, 23 bp, Artificial Sequence
  Synthetic
ccgttttttttttttcagctggt

SEQ ID NO: 12587 - DNA, 23 bp, Artificial Sequence
  Synthetic
ccgttttttttttttcccttatc

SEQ ID NO: 12588 - DNA, 23 bp, Artificial Sequence
  Synthetic
ccgttttttttttttctcatcaa

SEQ ID NO: 12589 - DNA, 23 bp, Artificial Sequence
  Synthetic
ccgttttttttttttgccgctgt

SEQ ID NO: 12590 - DNA, 23 bp, Artificial Sequence
  Synthetic
ccgttttttttttttaagaattg

SEQ ID NO: 12591 - DNA, 23 bp, Artificial Sequence
  Synthetic
ccgttttttttttttgaattctt

SEQ ID NO: 12592 - DNA, 23 bp, Artificial Sequence
  Synthetic
ccgttttttttttttgagcacgg

SEQ ID NO: 12593 - DNA, 23 bp, Artificial Sequence
  Synthetic
ccgttttttttttttcgtaccag

SEQ ID NO: 12594 - DNA, 23 bp, Artificial Sequence
  Synthetic
ccgttttttttttttaacggacg

SEQ ID NO: 12595 - DNA, 23 bp, Artificial Sequence
  Synthetic
ccgttttttttttttcaaagaga

SEQ ID NO: 12596 - DNA, 23 bp, Artificial Sequence
  Synthetic
ccgttttttttttttcagacaaa

SEQ ID NO: 12597 - DNA, 23 bp, Artificial Sequence
  Synthetic
ccgttttttttttttagagcacc

SEQ ID NO: 12598 - DNA, 23 bp, Artificial Sequence
  Synthetic
ccgttttttttttttctttctga

SEQ ID NO: 12599 - DNA, 23 bp, Artificial Sequence
  Synthetic
ccgttttttttttttctgagata

SEQ ID NO: 12600 - DNA, 23 bp, Artificial Sequence
  Synthetic
ccgttttttttttttcaacaaaa

SEQ ID NO: 12601 - DNA, 23 bp, Artificial Sequence
  Synthetic
ccgttttttttttttacatcttt

SEQ ID NO: 12602 - DNA, 23 bp, Artificial Sequence
  Synthetic
ccgttttttttttttatacagct

SEQ ID NO: 12603 - DNA, 23 bp, Artificial Sequence
  Synthetic
ccgttttttttttttataaagct

SEQ ID NO: 12604 - DNA, 23 bp, Artificial Sequence
  Synthetic
ccgttttttttttttaggataca

SEQ ID NO: 12605 - DNA, 23 bp, Artificial Sequence
  Synthetic
ccgttttttttttttgctcactc

SEQ ID NO: 12606 - DNA, 23 bp, Artificial Sequence
  Synthetic
ccgttttttttttttgctcactc

SEQ ID NO: 12607 - DNA, 23 bp, Artificial Sequence
  Synthetic
ccgttttttttttttgctcactc

SEQ ID NO: 12608 - DNA, 23 bp, Artificial Sequence
  Synthetic
ccgttttttttttttgctcactc

SEQ ID NO: 12609 - DNA, 23 bp, Artificial Sequence
  Synthetic
ccgttttttttttttgctcactc

SEQ ID NO: 12610 - DNA, 23 bp, Artificial Sequence
  Synthetic
ccgttttttttttttgctcactc

SEQ ID NO: 12611 - DNA, 23 bp, Artificial Sequence
  Synthetic
ccgttttttttttttgctcactc

SEQ ID NO: 12612 - DNA, 23 bp, Artificial Sequence
  Synthetic
ccgttttttttttttgctctctt

SEQ ID NO: 12613 - DNA, 23 bp, Artificial Sequence
  Synthetic
ccgttttttttttttgctctcta

SEQ ID NO: 12614 - DNA, 23 bp, Artificial Sequence
  Synthetic
ccgttttttttttttgctctcta

SEQ ID NO: 12615 - DNA, 23 bp, Artificial Sequence
  Synthetic
ccgttttttttttttgctctcta

SEQ ID NO: 12616 - DNA, 23 bp, Artificial Sequence
  Synthetic
ccgttttttttttttgctctcta

SEQ ID NO: 12617 - DNA, 23 bp, Artificial Sequence
  Synthetic
ccgttttttttttttctttgtct

SEQ ID NO: 12618 - DNA, 23 bp, Artificial Sequence
  Synthetic
ccgttttttttttttctttgtct

SEQ ID NO: 12619 - DNA, 23 bp, Artificial Sequence
  Synthetic
ccgttttttttttttgagctccc

SEQ ID NO: 12620 - DNA, 23 bp, Artificial Sequence
  Synthetic
ccgttttttttttttagagctcc

SEQ ID NO: 12621 - DNA, 23 bp, Artificial Sequence
  Synthetic
ccgttttttttttttggagctcc

SEQ ID NO: 12622 - DNA, 23 bp, Artificial Sequence
  Synthetic
ccgttttttttttttgcatacag

SEQ ID NO: 12623 - DNA, 23 bp, Artificial Sequence
  Synthetic
ccgttttttttttttgcatacag

SEQ ID NO: 12624 - DNA, 23 bp, Artificial Sequence
  Synthetic
ccgttttttttttttgcatacag

SEQ ID NO: 12625 - DNA, 23 bp, Artificial Sequence
  Synthetic
ccgttttttttttttcccgatgt

SEQ ID NO: 12626 - DNA, 23 bp, Artificial Sequence
  Synthetic
ccgttttttttttttggatgcag

SEQ ID NO: 12627 - DNA, 23 bp, Artificial Sequence
  Synthetic
ccgttttttttttttggatgcag

SEQ ID NO: 12628 - DNA, 23 bp, Artificial Sequence
  Synthetic
ccgttttttttttttcgaagttc

SEQ ID NO: 12629 - DNA, 23 bp, Artificial Sequence
  Synthetic
ccgttttttttttttcacgtgcc

SEQ ID NO: 12630 - DNA, 23 bp, Artificial Sequence
  Synthetic
ccgttttttttttttcacgtgcc

SEQ ID NO: 12631 - DNA, 23 bp, Artificial Sequence
  Synthetic
ccgttttttttttttgcacgtgc

SEQ ID NO: 12632 - DNA, 23 bp, Artificial Sequence
  Synthetic
ccgttttttttttttggggatga

SEQ ID NO: 12633 - DNA, 23 bp, Artificial Sequence
  Synthetic
ccgttttttttttttggggatga

SEQ ID NO: 12634 - DNA, 23 bp, Artificial Sequence
  Synthetic
ccgttttttttttttgggaatga

SEQ ID NO: 12635 - DNA, 23 bp, Artificial Sequence
  Synthetic
ccgttttttttttttgggaatga

SEQ ID NO: 12636 - DNA, 23 bp, Artificial Sequence
  Synthetic
ccgttttttttttttgggaatga

SEQ ID NO: 12637 - DNA, 23 bp, Artificial Sequence
  Synthetic
ccgttttttttttttgggaatga

SEQ ID NO: 12638 - DNA, 23 bp, Artificial Sequence
  Synthetic
ccgttttttttttttgggaatga

SEQ ID NO: 12639 - DNA, 23 bp, Artificial Sequence
  Synthetic
ccgttttttttttttgggaatga

SEQ ID NO: 12640 - DNA, 23 bp, Artificial Sequence
  Synthetic
ccgttttttttttttgggaatga

SEQ ID NO: 12641 - DNA, 23 bp, Artificial Sequence
  Synthetic
ccgttttttttttttgatcatgc

SEQ ID NO: 12642 - DNA, 23 bp, Artificial Sequence
  Synthetic
ccgttttttttttttgatcatgc

SEQ ID NO: 12643 - DNA, 23 bp, Artificial Sequence
  Synthetic
ccgttttttttttttagatcatg

SEQ ID NO: 12644 - DNA, 23 bp, Artificial Sequence
  Synthetic
ccgttttttttttttcagatcat

SEQ ID NO: 12645 - DNA, 23 bp, Artificial Sequence
  Synthetic
ccgttttttttttttccgacctg

SEQ ID NO: 12646 - DNA, 23 bp, Artificial Sequence
  Synthetic
ccgttttttttttttccgacctg

SEQ ID NO: 12647 - DNA, 23 bp, Artificial Sequence
  Synthetic
ccgttttttttttttggcaagtc

SEQ ID NO: 12648 - DNA, 23 bp, Artificial Sequence
  Synthetic
ccgttttttttttttcggcaagt

SEQ ID NO: 12649 - DNA, 23 bp, Artificial Sequence
  Synthetic
ccgttttttttttttcggcaagt

SEQ ID NO: 12650 - DNA, 23 bp, Artificial Sequence
  Synthetic
ccgttttttttttttggcaagtc

SEQ ID NO: 12651 - DNA, 23 bp, Artificial Sequence
  Synthetic
ccgttttttttttttggcaagtc

SEQ ID NO: 12652 - DNA, 23 bp, Artificial Sequence
  Synthetic
ccgttttttttttttggcaagtc

SEQ ID NO: 12653 - DNA, 23 bp, Artificial Sequence
  Synthetic
ccgttttttttttttggcaagtc

SEQ ID NO: 12654 - DNA, 23 bp, Artificial Sequence
  Synthetic
ccgttttttttttttgccaaggt

SEQ ID NO: 12655 - DNA, 23 bp, Artificial Sequence
  Synthetic
ccgttttttttttttaggcaagt

SEQ ID NO: 12656 - DNA, 23 bp, Artificial Sequence
  Synthetic
ccgttttttttttttaggcaagt

SEQ ID NO: 12657 - DNA, 23 bp, Artificial Sequence
  Synthetic
ccgttttttttttttaggcaagt

SEQ ID NO: 12658 - DNA, 23 bp, Artificial Sequence
  Synthetic
ccgttttttttttttaggcaagt

SEQ ID NO: 12659 - DNA, 23 bp, Artificial Sequence
  Synthetic
ccgttttttttttttaggcaagt

SEQ ID NO: 12660 - DNA, 23 bp, Artificial Sequence
  Synthetic
ccgttttttttttttaggcaagt

SEQ ID NO: 12661 - DNA, 23 bp, Artificial Sequence
  Synthetic
ccgttttttttttttaggcaagt

SEQ ID NO: 12662 - DNA, 23 bp, Artificial Sequence
  Synthetic
ccgttttttttttttatattgac

SEQ ID NO: 12663 - DNA, 23 bp, Artificial Sequence
  Synthetic
ccgttttttttttttatattggc

SEQ ID NO: 12664 - DNA, 23 bp, Artificial Sequence
  Synthetic
ccgttttttttttttgtgatatt

SEQ ID NO: 12665 - DNA, 23 bp, Artificial Sequence
  Synthetic
ccgttttttttttttgtgatatt

SEQ ID NO: 12666 - DNA, 23 bp, Artificial Sequence
  Synthetic
ccgttttttttttttgcagcatc

SEQ ID NO: 12667 - DNA, 23 bp, Artificial Sequence
  Synthetic
ccgttttttttttttgcagcatc

SEQ ID NO: 12668 - DNA, 23 bp, Artificial Sequence
  Synthetic
ccgttttttttttttgaatctta

SEQ ID NO: 12669 - DNA, 23 bp, Artificial Sequence
  Synthetic
ccgttttttttttttgcagcatc

SEQ ID NO: 12670 - DNA, 23 bp, Artificial Sequence
  Synthetic
ccgttttttttttttgcagcatc

SEQ ID NO: 12671 - DNA, 23 bp, Artificial Sequence
  Synthetic
ccgttttttttttttgcagcatc

SEQ ID NO: 12672 - DNA, 23 bp, Artificial Sequence
  Synthetic
ccgttttttttttttgatttctc

SEQ ID NO: 12673 - DNA, 23 bp, Artificial Sequence
  Synthetic
ccgttttttttttttggagctcc

SEQ ID NO: 12674 - DNA, 23 bp, Artificial Sequence
  Synthetic
ccgttttttttttttggagctcc

SEQ ID NO: 12675 - DNA, 23 bp, Artificial Sequence
  Synthetic
ccgttttttttttttggagctcc

SEQ ID NO: 12676 - DNA, 23 bp, Artificial Sequence
  Synthetic
ccgttttttttttttgcgctatc

SEQ ID NO: 12677 - DNA, 23 bp, Artificial Sequence
  Synthetic
ccgttttttttttttgcgctatc

SEQ ID NO: 12678 - DNA, 23 bp, Artificial Sequence
  Synthetic
ccgttttttttttttgcgctatc

SEQ ID NO: 12679 - DNA, 23 bp, Artificial Sequence
  Synthetic
ccgttttttttttttatcaatgc

SEQ ID NO: 12680 - DNA, 23 bp, Artificial Sequence
  Synthetic
ccgttttttttttttatcaatgc

SEQ ID NO: 12681 - DNA, 23 bp, Artificial Sequence
  Synthetic
ccgttttttttttttgaggtgga

SEQ ID NO: 12682 - DNA, 23 bp, Artificial Sequence
  Synthetic
ccgttttttttttttgaggtgga

SEQ ID NO: 12683 - DNA, 23 bp, Artificial Sequence
  Synthetic
ccgttttttttttttagttcccc

SEQ ID NO: 12684 - DNA, 23 bp, Artificial Sequence
  Synthetic
ccgttttttttttttagtccccc

SEQ ID NO: 12685 - DNA, 23 bp, Artificial Sequence
  Synthetic
ccgttttttttttttagtccccc

SEQ ID NO: 12686 - DNA, 23 bp, Artificial Sequence
  Synthetic
ccgttttttttttttagttcccc

SEQ ID NO: 12687 - DNA, 23 bp, Artificial Sequence
  Synthetic
ccgttttttttttttagttcccc

SEQ ID NO: 12688 - DNA, 23 bp, Artificial Sequence
  Synthetic
ccgttttttttttttagtccccc

SEQ ID NO: 12689 - DNA, 23 bp, Artificial Sequence
  Synthetic
ccgttttttttttttagttcaag

SEQ ID NO: 12690 - DNA, 23 bp, Artificial Sequence
  Synthetic
ccgttttttttttttagttcaag

SEQ ID NO: 12691 - DNA, 23 bp, Artificial Sequence
  Synthetic
ccgttttttttttttatcaacgc

SEQ ID NO: 12692 - DNA, 23 bp, Artificial Sequence
  Synthetic
ccgttttttttttttatcaacga

SEQ ID NO: 12693 - DNA, 23 bp, Artificial Sequence
  Synthetic
ccgttttttttttttaggggtga

SEQ ID NO: 12694 - DNA, 23 bp, Artificial Sequence
  Synthetic
ccgttttttttttttaggggtga

SEQ ID NO: 12695 - DNA, 23 bp, Artificial Sequence
  Synthetic
ccgttttttttttttaggggtga

SEQ ID NO: 12696 - DNA, 23 bp, Artificial Sequence
  Synthetic
ccgttttttttttttagggcaaa

SEQ ID NO: 12697 - DNA, 23 bp, Artificial Sequence
  Synthetic
ccgttttttttttttagggcaac

SEQ ID NO: 12698 - DNA, 23 bp, Artificial Sequence
  Synthetic
ccgttttttttttttagggcaac

SEQ ID NO: 12699 - DNA, 23 bp, Artificial Sequence
  Synthetic
ccgttttttttttttggggcaaa

SEQ ID NO: 12700 - DNA, 23 bp, Artificial Sequence
  Synthetic
ccgttttttttttttgaggcaaa

SEQ ID NO: 12701 - DNA, 23 bp, Artificial Sequence
  Synthetic
ccgttttttttttttcgggcaaa

SEQ ID NO: 12702 - DNA, 23 bp, Artificial Sequence
  Synthetic
ccgttttttttttttgacttata

SEQ ID NO: 12703 - DNA, 23 bp, Artificial Sequence
  Synthetic
ccgttttttttttttcggtcgac

SEQ ID NO: 12704 - DNA, 23 bp, Artificial Sequence
  Synthetic
ccgttttttttttttagaggttt

SEQ ID NO: 12705 - DNA, 23 bp, Artificial Sequence
  Synthetic
ccgttttttttttttgagtttgt

SEQ ID NO: 12706 - DNA, 23 bp, Artificial Sequence
  Synthetic
ccgttttttttttttctgccgca

SEQ ID NO: 12707 - DNA, 23 bp, Artificial Sequence
  Synthetic
ccgttttttttttttgttatggg

SEQ ID NO: 12708 - DNA, 23 bp, Artificial Sequence
  Synthetic
ccgttttttttttttgttatggg

SEQ ID NO: 12709 - DNA, 23 bp, Artificial Sequence
  Synthetic
ccgttttttttttttgttatggg

SEQ ID NO: 12710 - DNA, 23 bp, Artificial Sequence
  Synthetic
ccgttttttttttttggattaca

SEQ ID NO: 12711 - DNA, 23 bp, Artificial Sequence
  Synthetic
ccgttttttttttttccaaaagt

SEQ ID NO: 12712 - DNA, 23 bp, Artificial Sequence
  Synthetic
ccgttttttttttttccagggaa

SEQ ID NO: 12713 - DNA, 23 bp, Artificial Sequence
  Synthetic
ccgttttttttttttgcagaaca

SEQ ID NO: 12714 - DNA, 23 bp, Artificial Sequence
  Synthetic
ccgttttttttttttacgatgat

SEQ ID NO: 12715 - DNA, 23 bp, Artificial Sequence
  Synthetic
ccgttttttttttttgttctgtt

SEQ ID NO: 12716 - DNA, 23 bp, Artificial Sequence
  Synthetic
ccgttttttttttttaacagtgt

SEQ ID NO: 12717 - DNA, 23 bp, Artificial Sequence
  Synthetic
ccgttttttttttttgaacaaat

SEQ ID NO: 12718 - DNA, 23 bp, Artificial Sequence
  Synthetic
ccgttttttttttttgtcagttc

SEQ ID NO: 12719 - DNA, 23 bp, Artificial Sequence
  Synthetic
ccgttttttttttttaacatcct

SEQ ID NO: 12720 - DNA, 23 bp, Artificial Sequence
  Synthetic
ccgttttttttttttcatttccg

SEQ ID NO: 12721 - DNA, 23 bp, Artificial Sequence
  Synthetic
ccgttttttttttttgtaaggac

SEQ ID NO: 12722 - DNA, 23 bp, Artificial Sequence
  Synthetic
ccgttttttttttttaacaaaac

SEQ ID NO: 12723 - DNA, 23 bp, Artificial Sequence
  Synthetic
ccgttttttttttttaacaaaac

SEQ ID NO: 12724 - DNA, 23 bp, Artificial Sequence
  Synthetic
ccgttttttttttttaacaaaag

SEQ ID NO: 12725 - DNA, 23 bp, Artificial Sequence
  Synthetic
ccgttttttttttttagggctac

SEQ ID NO: 12726 - DNA, 23 bp, Artificial Sequence
  Synthetic
ccgttttttttttttatgggcgg

SEQ ID NO: 12727 - DNA, 23 bp, Artificial Sequence
  Synthetic
ccgttttttttttttagacaaaa

SEQ ID NO: 12728 - DNA, 23 bp, Artificial Sequence
  Synthetic
ccgttttttttttttatggccat

SEQ ID NO: 12729 - DNA, 23 bp, Artificial Sequence
  Synthetic
ccgttttttttttttgcactgct

SEQ ID NO: 12730 - DNA, 23 bp, Artificial Sequence
  Synthetic
ccgttttttttttttacatcaat

SEQ ID NO: 12731 - DNA, 23 bp, Artificial Sequence
  Synthetic
ccgttttttttttttgcaacgaa

SEQ ID NO: 12732 - DNA, 23 bp, Artificial Sequence
  Synthetic
ccgttttttttttttggtgtaca

SEQ ID NO: 12733 - DNA, 23 bp, Artificial Sequence
  Synthetic
ccgttttttttttttgagcagca

SEQ ID NO: 12734 - DNA, 23 bp, Artificial Sequence
  Synthetic
ccgttttttttttttccagatat

SEQ ID NO: 12735 - DNA, 23 bp, Artificial Sequence
  Synthetic
ccgttttttttttttagtatcca

SEQ ID NO: 12736 - DNA, 23 bp, Artificial Sequence
  Synthetic
ccgttttttttttttagaacatc

SEQ ID NO: 12737 - DNA, 23 bp, Artificial Sequence
  Synthetic
ccgttttttttttttaacatgaa

SEQ ID NO: 12738 - DNA, 23 bp, Artificial Sequence
  Synthetic
ccgttttttttttttctatacaa

SEQ ID NO: 12739 - DNA, 23 bp, Artificial Sequence
  Synthetic
ccgttttttttttttccatactt

SEQ ID NO: 12740 - DNA, 23 bp, Artificial Sequence
  Synthetic
ccgttttttttttttcaaattcg

SEQ ID NO: 12741 - DNA, 23 bp, Artificial Sequence
  Synthetic
ccgttttttttttttggcattca

SEQ ID NO: 12742 - DNA, 23 bp, Artificial Sequence
  Synthetic
ccgttttttttttttggagagag

SEQ ID NO: 12743 - DNA, 23 bp, Artificial Sequence
  Synthetic
ccgttttttttttttgaattctt

SEQ ID NO: 12744 - DNA, 23 bp, Artificial Sequence
  Synthetic
ccgttttttttttttgaattctc

SEQ ID NO: 12745 - DNA, 23 bp, Artificial Sequence
  Synthetic
ccgttttttttttttgcgcgcta

SEQ ID NO: 12746 - DNA, 23 bp, Artificial Sequence
  Synthetic
ccgttttttttttttgtaggaac

SEQ ID NO: 12747 - DNA, 23 bp, Artificial Sequence
  Synthetic
ccgttttttttttttcgtaccag

SEQ ID NO: 12748 - DNA, 23 bp, Artificial Sequence
  Synthetic
ccgttttttttttttgagtgtgg

SEQ ID NO: 12749 - DNA, 23 bp, Artificial Sequence
  Synthetic
ccgttttttttttttcagacaaa

SEQ ID NO: 12750 - DNA, 23 bp, Artificial Sequence
  Synthetic
ccgttttttttttttgaattacc

SEQ ID NO: 12751 - DNA, 23 bp, Artificial Sequence
  Synthetic
ccgttttttttttttagagcacc

SEQ ID NO: 12752 - DNA, 23 bp, Artificial Sequence
  Synthetic
ccgttttttttttttcactcaag

SEQ ID NO: 12753 - DNA, 23 bp, Artificial Sequence
  Synthetic
ccgttttttttttttagctatgc

SEQ ID NO: 12754 - DNA, 23 bp, Artificial Sequence
  Synthetic
ccgttttttttttttaaccagct

SEQ ID NO: 12755 - DNA, 23 bp, Artificial Sequence
  Synthetic
ccgttttttttttttcaacaaaa

SEQ ID NO: 12756 - DNA, 23 bp, Artificial Sequence
  Synthetic
ccgttttttttttttactaccca

SEQ ID NO: 12757 - DNA, 23 bp, Artificial Sequence
  Synthetic
ccgttttttttttttacatcttt

SEQ ID NO: 12758 - DNA, 23 bp, Artificial Sequence
  Synthetic
ccgttttttttttttatacagct

SEQ ID NO: 12759 - DNA, 23 bp, Artificial Sequence
  Synthetic
ccgttttttttttttactataca

SEQ ID NO: 12760 - DNA, 23 bp, Artificial Sequence
  Synthetic
ccgttttttttttttactatgca

SEQ ID NO: 12761 - DNA, 23 bp, Artificial Sequence
  Synthetic
ccgttttttttttttactataca

SEQ ID NO: 12762 - DNA, 23 bp, Artificial Sequence
  Synthetic
ccgttttttttttttactgtaca

SEQ ID NO: 12763 - DNA, 23 bp, Artificial Sequence
  Synthetic
ccgttttttttttttacagcaca

SEQ ID NO: 12764 - DNA, 23 bp, Artificial Sequence
  Synthetic
ccgttttttttttttagttatca

SEQ ID NO: 12765 - DNA, 23 bp, Artificial Sequence
  Synthetic
ccgttttttttttttatagccct

SEQ ID NO: 12766 - DNA, 23 bp, Artificial Sequence
  Synthetic
ccgttttttttttttcctgcact

SEQ ID NO: 12767 - DNA, 23 bp, Artificial Sequence
  Synthetic
ccgttttttttttttatagccct

SEQ ID NO: 12768 - DNA, 23 bp, Artificial Sequence
  Synthetic
ccgttttttttttttacaaattc

SEQ ID NO: 12769 - DNA, 23 bp, Artificial Sequence
  Synthetic
ccgttttttttttttacaaattc

SEQ ID NO: 12770 - DNA, 23 bp, Artificial Sequence
  Synthetic
ccgttttttttttttaaacacca

SEQ ID NO: 12771 - DNA, 23 bp, Artificial Sequence
  Synthetic
ccgttttttttttttgcattcac

SEQ ID NO: 12772 - DNA, 23 bp, Artificial Sequence
  Synthetic
ccgttttttttttttacaggtta

SEQ ID NO: 12773 - DNA, 23 bp, Artificial Sequence
  Synthetic
ccgttttttttttttacaagtta

SEQ ID NO: 12774 - DNA, 23 bp, Artificial Sequence
  Synthetic
ccgttttttttttttgcattatt

SEQ ID NO: 12775 - DNA, 23 bp, Artificial Sequence
  Synthetic
ccgttttttttttttgccaagct

SEQ ID NO: 12776 - DNA, 23 bp, Artificial Sequence
  Synthetic
ccgttttttttttttaaagagac

SEQ ID NO: 12777 - DNA, 23 bp, Artificial Sequence
  Synthetic
ccgttttttttttttgaccatgg

SEQ ID NO: 12778 - DNA, 23 bp, Artificial Sequence
  Synthetic
ccgttttttttttttggcctgat

SEQ ID NO: 12779 - DNA, 23 bp, Artificial Sequence
  Synthetic
ccgttttttttttttctggagac

SEQ ID NO: 12780 - DNA, 23 bp, Artificial Sequence
  Synthetic
ccgttttttttttttcgtggttc

SEQ ID NO: 12781 - DNA, 23 bp, Artificial Sequence
  Synthetic
ccgttttttttttttagtgcttt

SEQ ID NO: 12782 - DNA, 23 bp, Artificial Sequence
  Synthetic
ccgttttttttttttatccataa

SEQ ID NO: 12783 - DNA, 23 bp, Artificial Sequence
  Synthetic
ccgttttttttttttgggattcc

SEQ ID NO: 12784 - DNA, 23 bp, Artificial Sequence
  Synthetic
ccgttttttttttttcaaagttc

SEQ ID NO: 12785 - DNA, 23 bp, Artificial Sequence
  Synthetic
ccgttttttttttttcaaagttc

SEQ ID NO: 12786 - DNA, 23 bp, Artificial Sequence
  Synthetic
ccgttttttttttttcactggta

SEQ ID NO: 12787 - DNA, 23 bp, Artificial Sequence
  Synthetic
ccgttttttttttttctcaagga

SEQ ID NO: 12788 - DNA, 23 bp, Artificial Sequence
  Synthetic
ccgttttttttttttctagactg

SEQ ID NO: 12789 - DNA, 23 bp, Artificial Sequence
  Synthetic
ccgttttttttttttaaaccatg

SEQ ID NO: 12790 - DNA, 23 bp, Artificial Sequence
  Synthetic
ccgttttttttttttccaatatt

SEQ ID NO: 12791 - DNA, 23 bp, Artificial Sequence
  Synthetic
ccgttttttttttttcaagtgcc

SEQ ID NO: 12792 - DNA, 23 bp, Artificial Sequence
  Synthetic
ccgttttttttttttctacctgc

SEQ ID NO: 12793 - DNA, 23 bp, Artificial Sequence
  Synthetic
ccgttttttttttttactcaccg

SEQ ID NO: 12794 - DNA, 23 bp, Artificial Sequence
  Synthetic
ccgttttttttttttaacccacc

SEQ ID NO: 12795 - DNA, 23 bp, Artificial Sequence
  Synthetic
ccgttttttttttttaactcacc

SEQ ID NO: 12796 - DNA, 23 bp, Artificial Sequence
  Synthetic
ccgttttttttttttgcccaaaa

SEQ ID NO: 12797 - DNA, 23 bp, Artificial Sequence
  Synthetic
ccgttttttttttttctgcacta

SEQ ID NO: 12798 - DNA, 23 bp, Artificial Sequence
  Synthetic
ccgttttttttttttactgcact

SEQ ID NO: 12799 - DNA, 23 bp, Artificial Sequence
  Synthetic
ccgttttttttttttagctgctt

SEQ ID NO: 12800 - DNA, 23 bp, Artificial Sequence
  Synthetic
ccgttttttttttttggctgtca

SEQ ID NO: 12801 - DNA, 23 bp, Artificial Sequence
  Synthetic
ccgttttttttttttctgggact

SEQ ID NO: 12802 - DNA, 23 bp, Artificial Sequence
  Synthetic
ccgttttttttttttatctcgcc

SEQ ID NO: 12803 - DNA, 23 bp, Artificial Sequence
  Synthetic
ccgttttttttttttacaggtag

SEQ ID NO: 12804 - DNA, 23 bp, Artificial Sequence
  Synthetic
ccgttttttttttttaccaatgt

SEQ ID NO: 12805 - DNA, 23 bp, Artificial Sequence
  Synthetic
ccgttttttttttttaacagata

SEQ ID NO: 12806 - DNA, 23 bp, Artificial Sequence
  Synthetic
ccgttttttttttttacatcgtt

SEQ ID NO: 12807 - DNA, 23 bp, Artificial Sequence
  Synthetic
ccgttttttttttttatcattac

SEQ ID NO: 12808 - DNA, 23 bp, Artificial Sequence
  Synthetic
ccgttttttttttttcatcatta

SEQ ID NO: 12809 - DNA, 23 bp, Artificial Sequence
  Synthetic
ccgttttttttttttagactccg

SEQ ID NO: 12810 - DNA, 23 bp, Artificial Sequence
  Synthetic
ccgttttttttttttacctgcac

SEQ ID NO: 12811 - DNA, 23 bp, Artificial Sequence
  Synthetic
ccgttttttttttttcctgcact

SEQ ID NO: 12812 - DNA, 23 bp, Artificial Sequence
  Synthetic
ccgttttttttttttgtcaacat

SEQ ID NO: 12813 - DNA, 23 bp, Artificial Sequence
  Synthetic
ccgttttttttttttgacagccc

SEQ ID NO: 12814 - DNA, 23 bp, Artificial Sequence
  Synthetic
ccgttttttttttttagccgctg

SEQ ID NO: 12815 - DNA, 23 bp, Artificial Sequence
  Synthetic
ccgttttttttttttctgcctgt

SEQ ID NO: 12816 - DNA, 23 bp, Artificial Sequence
  Synthetic
ccgttttttttttttctgtcaat

SEQ ID NO: 12817 - DNA, 23 bp, Artificial Sequence
  Synthetic
ccgttttttttttttcatggtta

SEQ ID NO: 12818 - DNA, 23 bp, Artificial Sequence
  Synthetic
ccgttttttttttttaagcttgc

SEQ ID NO: 12819 - DNA, 23 bp, Artificial Sequence
  Synthetic
ccgttttttttttttaacccagc

SEQ ID NO: 12820 - DNA, 23 bp, Artificial Sequence
  Synthetic
ccgttttttttttttcccagtag

SEQ ID NO: 12821 - DNA, 23 bp, Artificial Sequence
  Synthetic
ccgttttttttttttgaaatccc

SEQ ID NO: 12822 - DNA, 23 bp, Artificial Sequence
  Synthetic
ccgttttttttttttggtaatcc

SEQ ID NO: 12823 - DNA, 23 bp, Artificial Sequence
  Synthetic
ccgttttttttttttgttcctgc

SEQ ID NO: 12824 - DNA, 23 bp, Artificial Sequence
  Synthetic
ccgttttttttttttagaccgag

SEQ ID NO: 12825 - DNA, 23 bp, Artificial Sequence
  Synthetic
ccgttttttttttttgcctatcc

SEQ ID NO: 12826 - DNA, 23 bp, Artificial Sequence
  Synthetic
ccgttttttttttttacctatcc

SEQ ID NO: 12827 - DNA, 23 bp, Artificial Sequence
  Synthetic
ccgttttttttttttggaactta

SEQ ID NO: 12828 - DNA, 23 bp, Artificial Sequence
  Synthetic
ccgttttttttttttcagaactt

SEQ ID NO: 12829 - DNA, 23 bp, Artificial Sequence
  Synthetic
ccgttttttttttttaccgattt

SEQ ID NO: 12830 - DNA, 23 bp, Artificial Sequence
  Synthetic
ccgttttttttttttaacactga

SEQ ID NO: 12831 - DNA, 23 bp, Artificial Sequence
  Synthetic
ccgttttttttttttaccgattt

SEQ ID NO: 12832 - DNA, 23 bp, Artificial Sequence
  Synthetic
ccgttttttttttttgcttccag

SEQ ID NO: 12833 - DNA, 23 bp, Artificial Sequence
  Synthetic
ccgttttttttttttgctgagtg

SEQ ID NO: 12834 - DNA, 23 bp, Artificial Sequence
  Synthetic
ccgttttttttttttctgagagt

SEQ ID NO: 12835 - DNA, 23 bp, Artificial Sequence
  Synthetic
ccgttttttttttttgcttccag

SEQ ID NO: 12836 - DNA, 23 bp, Artificial Sequence
  Synthetic
ccgttttttttttttgcttccag

SEQ ID NO: 12837 - DNA, 23 bp, Artificial Sequence
  Synthetic
ccgttttttttttttgctatgcc

SEQ ID NO: 12838 - DNA, 23 bp, Artificial Sequence
  Synthetic
ccgttttttttttttgccctctc

SEQ ID NO: 12839 - DNA, 23 bp, Artificial Sequence
  Synthetic
ccgttttttttttttgatgggtg

SEQ ID NO: 12840 - DNA, 23 bp, Artificial Sequence
  Synthetic
ccgttttttttttttgcactgga

SEQ ID NO: 12841 - DNA, 23 bp, Artificial Sequence
  Synthetic
ccgttttttttttttaatcagct

SEQ ID NO: 12842 - DNA, 23 bp, Artificial Sequence
  Synthetic
ccgttttttttttttaatcagct

SEQ ID NO: 12843 - DNA, 23 bp, Artificial Sequence
  Synthetic
ccgttttttttttttacccctgg

SEQ ID NO: 12844 - DNA, 23 bp, Artificial Sequence
  Synthetic
ccgttttttttttttgcagatgg

SEQ ID NO: 12845 - DNA, 23 bp, Artificial Sequence
  Synthetic
ccgttttttttttttaagatcaa

SEQ ID NO: 12846 - DNA, 23 bp, Artificial Sequence
  Synthetic
ccgttttttttttttcgaatata

SEQ ID NO: 12847 - DNA, 23 bp, Artificial Sequence
  Synthetic
ccgttttttttttttgacgtgga

SEQ ID NO: 12848 - DNA, 23 bp, Artificial Sequence
  Synthetic
ccgttttttttttttcgcatgtt

SEQ ID NO: 12849 - DNA, 23 bp, Artificial Sequence
  Synthetic
ccgttttttttttttctgagggg

SEQ ID NO: 12850 - DNA, 23 bp, Artificial Sequence
  Synthetic
ccgttttttttttttggcggaca

SEQ ID NO: 12851 - DNA, 23 bp, Artificial Sequence
  Synthetic
ccgttttttttttttaacgggag

SEQ ID NO: 12852 - DNA, 23 bp, Artificial Sequence
  Synthetic
ccgttttttttttttattaggaa

SEQ ID NO: 12853 - DNA, 23 bp, Artificial Sequence
  Synthetic
ccgttttttttttttatgtagtc

SEQ ID NO: 12854 - DNA, 23 bp, Artificial Sequence
  Synthetic
ccgttttttttttttgtgtatat

SEQ ID NO: 12855 - DNA, 23 bp, Artificial Sequence
  Synthetic
ccgttttttttttttcgggaggg

SEQ ID NO: 12856 - DNA, 23 bp, Artificial Sequence
  Synthetic
ccgttttttttttttctggatgt

SEQ ID NO: 12857 - DNA, 23 bp, Artificial Sequence
  Synthetic
ccgttttttttttttagtggatg

SEQ ID NO: 12858 - DNA, 23 bp, Artificial Sequence
  Synthetic
ccgttttttttttttaacatcac

SEQ ID NO: 12859 - DNA, 23 bp, Artificial Sequence
  Synthetic
ccgttttttttttttcggtccta

SEQ ID NO: 12860 - DNA, 23 bp, Artificial Sequence
  Synthetic
ccgttttttttttttatccaata

SEQ ID NO: 12861 - DNA, 23 bp, Artificial Sequence
  Synthetic
ccgttttttttttttacacaata

SEQ ID NO: 12862 - DNA, 23 bp, Artificial Sequence
  Synthetic
ccgttttttttttttacaacaaa

SEQ ID NO: 12863 - DNA, 23 bp, Artificial Sequence
  Synthetic
ccgttttttttttttcaggccgg

SEQ ID NO: 12864 - DNA, 23 bp, Artificial Sequence
  Synthetic
ccgttttttttttttcctgcacg

SEQ ID NO: 12865 - DNA, 23 bp, Artificial Sequence
  Synthetic
ccgttttttttttttacaataca

SEQ ID NO: 12866 - DNA, 23 bp, Artificial Sequence
  Synthetic
ccgttttttttttttcaagatcg

SEQ ID NO: 12867 - DNA, 23 bp, Artificial Sequence
  Synthetic
ccgttttttttttttactataca

SEQ ID NO: 12868 - DNA, 23 bp, Artificial Sequence
  Synthetic
ccgttttttttttttacacttga

SEQ ID NO: 12869 - DNA, 23 bp, Artificial Sequence
  Synthetic
ccgttttttttttttggaatgcg

SEQ ID NO: 12870 - DNA, 23 bp, Artificial Sequence
  Synthetic
ccgttttttttttttcatacttc

SEQ ID NO: 12871 - DNA, 23 bp, Artificial Sequence
  Synthetic
ccgttttttttttttgcattcac

SEQ ID NO: 12872 - DNA, 23 bp, Artificial Sequence
  Synthetic
ccgttttttttttttcgtgaatt

SEQ ID NO: 12873 - DNA, 23 bp, Artificial Sequence
  Synthetic
ccgttttttttttttctggtcgc

SEQ ID NO: 12874 - DNA, 23 bp, Artificial Sequence
  Synthetic
ccgttttttttttttctgcctgt

SEQ ID NO: 12875 - DNA, 23 bp, Artificial Sequence
  Synthetic
ccgttttttttttttaccgcagt

SEQ ID NO: 12876 - DNA, 23 bp, Artificial Sequence
  Synthetic
ccgttttttttttttccgcacat

SEQ ID NO: 12877 - DNA, 23 bp, Artificial Sequence
  Synthetic
ccgttttttttttttagggtatt

SEQ ID NO: 12878 - DNA, 23 bp, Artificial Sequence
  Synthetic
ccgttttttttttttgcgtcatt

SEQ ID NO: 12879 - DNA, 23 bp, Artificial Sequence
  Synthetic
ccgttttttttttttcagtacct

SEQ ID NO: 12880 - DNA, 23 bp, Artificial Sequence
  Synthetic
ccgttttttttttttagtacttt

SEQ ID NO: 12881 - DNA, 23 bp, Artificial Sequence
  Synthetic
ccgttttttttttttgcgaaaat

SEQ ID NO: 12882 - DNA, 23 bp, Artificial Sequence
  Synthetic
ccgttttttttttttatttctca

SEQ ID NO: 12883 - DNA, 23 bp, Artificial Sequence
  Synthetic
ccgttttttttttttataccact

SEQ ID NO: 12884 - DNA, 23 bp, Artificial Sequence
  Synthetic
ccgttttttttttttagctactt

SEQ ID NO: 12885 - DNA, 23 bp, Artificial Sequence
  Synthetic
ccgttttttttttttgctcctac

SEQ ID NO: 12886 - DNA, 23 bp, Artificial Sequence
  Synthetic
ccgttttttttttttagcgttat

SEQ ID NO: 12887 - DNA, 23 bp, Artificial Sequence
  Synthetic
ccgttttttttttttcaacactc

SEQ ID NO: 12888 - DNA, 23 bp, Artificial Sequence
  Synthetic
ccgttttttttttttcgtgccaa

SEQ ID NO: 12889 - DNA, 23 bp, Artificial Sequence
  Synthetic
ccgttttttttttttataagagc

SEQ ID NO: 12890 - DNA, 23 bp, Artificial Sequence
  Synthetic
ccgttttttttttttacctgcgg

SEQ ID NO: 12891 - DNA, 23 bp, Artificial Sequence
  Synthetic
ccgttttttttttttgttagtgt

SEQ ID NO: 12892 - DNA, 23 bp, Artificial Sequence
  Synthetic
ccgttttttttttttacagttgc

SEQ ID NO: 12893 - DNA, 23 bp, Artificial Sequence
  Synthetic
ccgttttttttttttaccagatt

SEQ ID NO: 12894 - DNA, 23 bp, Artificial Sequence
  Synthetic
ccgttttttttttttccaaaact

SEQ ID NO: 12895 - DNA, 23 bp, Artificial Sequence
  Synthetic
ccgttttttttttttaaccagct

SEQ ID NO: 12896 - DNA, 23 bp, Artificial Sequence
  Synthetic
ccgttttttttttttgcaagttt

SEQ ID NO: 12897 - DNA, 23 bp, Artificial Sequence
  Synthetic
ccgttttttttttttataccaac

SEQ ID NO: 12898 - DNA, 23 bp, Artificial Sequence
  Synthetic
ccgttttttttttttggagcagc

SEQ ID NO: 12899 - DNA, 23 bp, Artificial Sequence
  Synthetic
ccgttttttttttttatagctca

SEQ ID NO: 12900 - DNA, 23 bp, Artificial Sequence
  Synthetic
ccgttttttttttttgatttgtt

SEQ ID NO: 12901 - DNA, 23 bp, Artificial Sequence
  Synthetic
ccgttttttttttttcgtcaatg

SEQ ID NO: 12902 - DNA, 23 bp, Artificial Sequence
  Synthetic
ccgttttttttttttcacgacta

SEQ ID NO: 12903 - DNA, 23 bp, Artificial Sequence
  Synthetic
ccgttttttttttttgcgaattt

SEQ ID NO: 12904 - DNA, 23 bp, Artificial Sequence
  Synthetic
ccgttttttttttttgaacggga

SEQ ID NO: 12905 - DNA, 23 bp, Artificial Sequence
  Synthetic
ccgttttttttttttaccaggtt

SEQ ID NO: 12906 - DNA, 23 bp, Artificial Sequence
  Synthetic
ccgttttttttttttaaccgttt

SEQ ID NO: 12907 - DNA, 23 bp, Artificial Sequence
  Synthetic
ccgttttttttttttagctgatt

SEQ ID NO: 12908 - DNA, 23 bp, Artificial Sequence
  Synthetic
ccgttttttttttttggagtttt

SEQ ID NO: 12909 - DNA, 23 bp, Artificial Sequence
  Synthetic
ccgttttttttttttgtagatgt

SEQ ID NO: 12910 - DNA, 23 bp, Artificial Sequence
  Synthetic
ccgttttttttttttcgacagca

SEQ ID NO: 12911 - DNA, 23 bp, Artificial Sequence
  Synthetic
ccgttttttttttttgctgaatg

SEQ ID NO: 12912 - DNA, 23 bp, Artificial Sequence
  Synthetic
ccgttttttttttttgctgaatg

SEQ ID NO: 12913 - DNA, 23 bp, Artificial Sequence
  Synthetic
ccgttttttttttttaagagagc

SEQ ID NO: 12914 - DNA, 23 bp, Artificial Sequence
  Synthetic
ccgttttttttttttaagagagc

SEQ ID NO: 12915 - DNA, 23 bp, Artificial Sequence
  Synthetic
ccgttttttttttttgcatctac

SEQ ID NO: 12916 - DNA, 23 bp, Artificial Sequence
  Synthetic
ccgttttttttttttgcagcttc

SEQ ID NO: 12917 - DNA, 23 bp, Artificial Sequence
  Synthetic
ccgttttttttttttacccaaga

SEQ ID NO: 12918 - DNA, 23 bp, Artificial Sequence
  Synthetic
ccgttttttttttttacatggca

SEQ ID NO: 12919 - DNA, 23 bp, Artificial Sequence
  Synthetic
ccgttttttttttttgcacggaa

SEQ ID NO: 12920 - DNA, 23 bp, Artificial Sequence
  Synthetic
ccgttttttttttttcggcagaa

SEQ ID NO: 12921 - DNA, 23 bp, Artificial Sequence
  Synthetic
ccgttttttttttttcacacagc

SEQ ID NO: 12922 - DNA, 23 bp, Artificial Sequence
  Synthetic
ccgttttttttttttgccgtact

SEQ ID NO: 12923 - DNA, 23 bp, Artificial Sequence
  Synthetic
ccgttttttttttttgactagaa

SEQ ID NO: 12924 - DNA, 23 bp, Artificial Sequence
  Synthetic
ccgttttttttttttagcagagt

SEQ ID NO: 12925 - DNA, 23 bp, Artificial Sequence
  Synthetic
ccgttttttttttttgtaagcta

SEQ ID NO: 12926 - DNA, 23 bp, Artificial Sequence
  Synthetic
ccgttttttttttttcgtacacg

SEQ ID NO: 12927 - DNA, 23 bp, Artificial Sequence
  Synthetic
ccgttttttttttttactctttc

SEQ ID NO: 12928 - DNA, 23 bp, Artificial Sequence
  Synthetic
ccgttttttttttttgggaacac

SEQ ID NO: 12929 - DNA, 23 bp, Artificial Sequence
  Synthetic
ccgttttttttttttactaccca

SEQ ID NO: 12930 - DNA, 23 bp, Artificial Sequence
  Synthetic
ccgttttttttttttctatgcca

SEQ ID NO: 12931 - DNA, 23 bp, Artificial Sequence
  Synthetic
ccgttttttttttttctgaactg

SEQ ID NO: 12932 - DNA, 23 bp, Artificial Sequence
  Synthetic
ccgttttttttttttagactgcc

SEQ ID NO: 12933 - DNA, 23 bp, Artificial Sequence
  Synthetic
ccgttttttttttttaaggcggt

SEQ ID NO: 12934 - DNA, 23 bp, Artificial Sequence
  Synthetic
ccgttttttttttttgacagcta

SEQ ID NO: 12935 - DNA, 23 bp, Artificial Sequence
  Synthetic
ccgttttttttttttgctttggt

SEQ ID NO: 12936 - DNA, 23 bp, Artificial Sequence
  Synthetic
ccgttttttttttttggctttca

SEQ ID NO: 12937 - DNA, 23 bp, Artificial Sequence
  Synthetic
ccgttttttttttttctagcttt

SEQ ID NO: 12938 - DNA, 23 bp, Artificial Sequence
  Synthetic
ccgttttttttttttctggcttt

SEQ ID NO: 12939 - DNA, 23 bp, Artificial Sequence
  Synthetic
ccgttttttttttttcactgaat

SEQ ID NO: 12940 - DNA, 23 bp, Artificial Sequence
  Synthetic
ccgttttttttttttacagcatt

SEQ ID NO: 12941 - DNA, 23 bp, Artificial Sequence
  Synthetic
ccgttttttttttttcacgcctt

SEQ ID NO: 12942 - DNA, 23 bp, Artificial Sequence
  Synthetic
ccgttttttttttttactgtggc

SEQ ID NO: 12943 - DNA, 23 bp, Artificial Sequence
  Synthetic
ccgttttttttttttcacctgaa

SEQ ID NO: 12944 - DNA, 23 bp, Artificial Sequence
  Synthetic
ccgttttttttttttgggcattc

SEQ ID NO: 12945 - DNA, 23 bp, Artificial Sequence
  Synthetic
ccgttttttttttttactataca

SEQ ID NO: 12946 - DNA, 23 bp, Artificial Sequence
  Synthetic
ccgttttttttttttacacttga

SEQ ID NO: 12947 - DNA, 23 bp, Artificial Sequence
  Synthetic
ccgttttttttttttgaaatgcg

SEQ ID NO: 12948 - DNA, 23 bp, Artificial Sequence
  Synthetic
ccgttttttttttttcatacttc

SEQ ID NO: 12949 - DNA, 23 bp, Artificial Sequence
  Synthetic
ccgttttttttttttgcattcac

SEQ ID NO: 12950 - DNA, 23 bp, Artificial Sequence
  Synthetic
ccgttttttttttttcacatcaa

SEQ ID NO: 12951 - DNA, 23 bp, Artificial Sequence
  Synthetic
ccgttttttttttttcagaatca

SEQ ID NO: 12952 - DNA, 23 bp, Artificial Sequence
  Synthetic
ccgttttttttttttcgtgaatt

SEQ ID NO: 12953 - DNA, 23 bp, Artificial Sequence
  Synthetic
ccgttttttttttttcgatggaa

SEQ ID NO: 12954 - DNA, 23 bp, Artificial Sequence
  Synthetic
ccgttttttttttttcctggtcg

SEQ ID NO: 12955 - DNA, 23 bp, Artificial Sequence
  Synthetic
ccgttttttttttttgcctgttg

SEQ ID NO: 12956 - DNA, 23 bp, Artificial Sequence
  Synthetic
ccgttttttttttttaccgcagt

SEQ ID NO: 12957 - DNA, 23 bp, Artificial Sequence
  Synthetic
ccgttttttttttttccgcacat

SEQ ID NO: 12958 - DNA, 23 bp, Artificial Sequence
  Synthetic
ccgttttttttttttagggtatt

SEQ ID NO: 12959 - DNA, 23 bp, Artificial Sequence
  Synthetic
ccgttttttttttttaggccggg

SEQ ID NO: 12960 - DNA, 23 bp, Artificial Sequence
  Synthetic
ccgttttttttttttgcgtcatt

SEQ ID NO: 12961 - DNA, 23 bp, Artificial Sequence
  Synthetic
ccgttttttttttttagctgttc

SEQ ID NO: 12962 - DNA, 23 bp, Artificial Sequence
  Synthetic
ccgttttttttttttgaatggca

SEQ ID NO: 12963 - DNA, 23 bp, Artificial Sequence
  Synthetic
ccgttttttttttttcagtacct

SEQ ID NO: 12964 - DNA, 23 bp, Artificial Sequence
  Synthetic
ccgttttttttttttagtacttt

SEQ ID NO: 12965 - DNA, 23 bp, Artificial Sequence
  Synthetic
ccgttttttttttttgcgaagat

SEQ ID NO: 12966 - DNA, 23 bp, Artificial Sequence
  Synthetic
ccgttttttttttttatttctcg

SEQ ID NO: 12967 - DNA, 23 bp, Artificial Sequence
  Synthetic
ccgttttttttttttgaagcaaa

SEQ ID NO: 12968 - DNA, 23 bp, Artificial Sequence
  Synthetic
ccgttttttttttttatatcccg

SEQ ID NO: 12969 - DNA, 23 bp, Artificial Sequence
  Synthetic
ccgttttttttttttataccact

SEQ ID NO: 12970 - DNA, 23 bp, Artificial Sequence
  Synthetic
ccgttttttttttttagctactt

SEQ ID NO: 12971 - DNA, 23 bp, Artificial Sequence
  Synthetic
ccgttttttttttttgctcctac

SEQ ID NO: 12972 - DNA, 23 bp, Artificial Sequence
  Synthetic
ccgttttttttttttagaagaga

SEQ ID NO: 12973 - DNA, 23 bp, Artificial Sequence
  Synthetic
ccgttttttttttttagcgttat

SEQ ID NO: 12974 - DNA, 23 bp, Artificial Sequence
  Synthetic
ccgttttttttttttcaacgctc

SEQ ID NO: 12975 - DNA, 23 bp, Artificial Sequence
  Synthetic
ccgttttttttttttcatgccaa

SEQ ID NO: 12976 - DNA, 23 bp, Artificial Sequence
  Synthetic
ccgttttttttttttataagagc

SEQ ID NO: 12977 - DNA, 23 bp, Artificial Sequence
  Synthetic
ccgttttttttttttacctgcgg

SEQ ID NO: 12978 - DNA, 23 bp, Artificial Sequence
  Synthetic
ccgttttttttttttgtcagtgt

SEQ ID NO: 12979 - DNA, 23 bp, Artificial Sequence
  Synthetic
ccgttttttttttttctacagtc

SEQ ID NO: 12980 - DNA, 23 bp, Artificial Sequence
  Synthetic
ccgttttttttttttcagtcttc

SEQ ID NO: 12981 - DNA, 23 bp, Artificial Sequence
  Synthetic
ccgttttttttttttactgggta

SEQ ID NO: 12982 - DNA, 23 bp, Artificial Sequence
  Synthetic
ccgttttttttttttaaaggatt

SEQ ID NO: 12983 - DNA, 23 bp, Artificial Sequence
  Synthetic
ccgttttttttttttccagatta

SEQ ID NO: 12984 - DNA, 23 bp, Artificial Sequence
  Synthetic
ccgttttttttttttacaagagt

SEQ ID NO: 12985 - DNA, 23 bp, Artificial Sequence
  Synthetic
ccgttttttttttttgtgaaaac

SEQ ID NO: 12986 - DNA, 23 bp, Artificial Sequence
  Synthetic
ccgttttttttttttcagaaaac

SEQ ID NO: 12987 - DNA, 23 bp, Artificial Sequence
  Synthetic
ccgttttttttttttataacaac

SEQ ID NO: 12988 - DNA, 23 bp, Artificial Sequence
  Synthetic
ccgttttttttttttaccaccct

SEQ ID NO: 12989 - DNA, 23 bp, Artificial Sequence
  Synthetic
ccgttttttttttttctttgcca

SEQ ID NO: 12990 - DNA, 23 bp, Artificial Sequence
  Synthetic
ccgttttttttttttcagcagac

SEQ ID NO: 12991 - DNA, 23 bp, Artificial Sequence
  Synthetic
ccgttttttttttttccaaactg

SEQ ID NO: 12992 - DNA, 23 bp, Artificial Sequence
  Synthetic
ccgttttttttttttgttttgcc

SEQ ID NO: 12993 - DNA, 23 bp, Artificial Sequence
  Synthetic
ccgttttttttttttccactgct

SEQ ID NO: 12994 - DNA, 23 bp, Artificial Sequence
  Synthetic
ccgttttttttttttatgctttc

SEQ ID NO: 12995 - DNA, 23 bp, Artificial Sequence
  Synthetic
ccgttttttttttttaaacaccc

SEQ ID NO: 12996 - DNA, 23 bp, Artificial Sequence
  Synthetic
ccgttttttttttttagccgaca

SEQ ID NO: 12997 - DNA, 23 bp, Artificial Sequence
  Synthetic
ccgttttttttttttaaccagct

SEQ ID NO: 12998 - DNA, 23 bp, Artificial Sequence
  Synthetic
ccgttttttttttttctgctagt

SEQ ID NO: 12999 - DNA, 23 bp, Artificial Sequence
  Synthetic
ccgttttttttttttataccaac

SEQ ID NO: 13000 - DNA, 23 bp, Artificial Sequence
  Synthetic
ccgttttttttttttggagcagc

SEQ ID NO: 13001 - DNA, 23 bp, Artificial Sequence
  Synthetic
ccgttttttttttttatagctca

SEQ ID NO: 13002 - DNA, 23 bp, Artificial Sequence
  Synthetic
ccgttttttttttttatttgttc

SEQ ID NO: 13003 - DNA, 23 bp, Artificial Sequence
  Synthetic
ccgttttttttttttctgcaacg

SEQ ID NO: 13004 - DNA, 23 bp, Artificial Sequence
  Synthetic
ccgttttttttttttcttgacag

SEQ ID NO: 13005 - DNA, 23 bp, Artificial Sequence
  Synthetic
ccgttttttttttttgtcagaga

SEQ ID NO: 13006 - DNA, 23 bp, Artificial Sequence
  Synthetic
ccgttttttttttttatgcgaat

SEQ ID NO: 13007 - DNA, 23 bp, Artificial Sequence
  Synthetic
ccgttttttttttttgaacggga

SEQ ID NO: 13008 - DNA, 23 bp, Artificial Sequence
  Synthetic
ccgttttttttttttctgcaagt

SEQ ID NO: 13009 - DNA, 23 bp, Artificial Sequence
  Synthetic
ccgttttttttttttctccagtt

SEQ ID NO: 13010 - DNA, 23 bp, Artificial Sequence
  Synthetic
ccgttttttttttttaagctgat

SEQ ID NO: 13011 - DNA, 23 bp, Artificial Sequence
  Synthetic
ccgttttttttttttatcacacg

SEQ ID NO: 13012 - DNA, 23 bp, Artificial Sequence
  Synthetic
ccgttttttttttttgctgatgt

SEQ ID NO: 13013 - DNA, 23 bp, Artificial Sequence
  Synthetic
ccgttttttttttttggtgattt

SEQ ID NO: 13014 - DNA, 23 bp, Artificial Sequence
  Synthetic
ccgttttttttttttgtagatgt

SEQ ID NO: 13015 - DNA, 23 bp, Artificial Sequence
  Synthetic
ccgttttttttttttcgacagca

SEQ ID NO: 13016 - DNA, 23 bp, Artificial Sequence
  Synthetic
ccgttttttttttttgctgaatg

SEQ ID NO: 13017 - DNA, 23 bp, Artificial Sequence
  Synthetic
ccgttttttttttttgctgaatg

SEQ ID NO: 13018 - DNA, 23 bp, Artificial Sequence
  Synthetic
ccgttttttttttttaagagagc

SEQ ID NO: 13019 - DNA, 23 bp, Artificial Sequence
  Synthetic
ccgttttttttttttaagagagc

SEQ ID NO: 13020 - DNA, 23 bp, Artificial Sequence
  Synthetic
ccgttttttttttttgcatctac

SEQ ID NO: 13021 - DNA, 23 bp, Artificial Sequence
  Synthetic
ccgttttttttttttgcagcttc

SEQ ID NO: 13022 - DNA, 23 bp, Artificial Sequence
  Synthetic
ccgttttttttttttacccaaga

SEQ ID NO: 13023 - DNA, 23 bp, Artificial Sequence
  Synthetic
ccgttttttttttttacatggat

SEQ ID NO: 13024 - DNA, 23 bp, Artificial Sequence
  Synthetic
ccgttttttttttttgcacggaa

SEQ ID NO: 13025 - DNA, 23 bp, Artificial Sequence
  Synthetic
ccgttttttttttttgcacggaa

SEQ ID NO: 13026 - DNA, 23 bp, Artificial Sequence
  Synthetic
ccgttttttttttttcggattat

SEQ ID NO: 13027 - DNA, 23 bp, Artificial Sequence
  Synthetic
ccgttttttttttttcagcagaa

SEQ ID NO: 13028 - DNA, 23 bp, Artificial Sequence
  Synthetic
ccgttttttttttttcagcggaa

SEQ ID NO: 13029 - DNA, 23 bp, Artificial Sequence
  Synthetic
ccgttttttttttttcaacccaa

SEQ ID NO: 13030 - DNA, 23 bp, Artificial Sequence
  Synthetic
ccgttttttttttttcacacagc

SEQ ID NO: 13031 - DNA, 23 bp, Artificial Sequence
  Synthetic
ccgttttttttttttgccgtact

SEQ ID NO: 13032 - DNA, 23 bp, Artificial Sequence
  Synthetic
ccgttttttttttttatcatcct

SEQ ID NO: 13033 - DNA, 23 bp, Artificial Sequence
  Synthetic
ccgttttttttttttaactagaa

SEQ ID NO: 13034 - DNA, 23 bp, Artificial Sequence
  Synthetic
ccgttttttttttttagatgagt

SEQ ID NO: 13035 - DNA, 23 bp, Artificial Sequence
  Synthetic
ccgttttttttttttgtaagcta

SEQ ID NO: 13036 - DNA, 23 bp, Artificial Sequence
  Synthetic
ccgttttttttttttcaactcgc

SEQ ID NO: 13037 - DNA, 23 bp, Artificial Sequence
  Synthetic
ccgttttttttttttggtaacgc

SEQ ID NO: 13038 - DNA, 23 bp, Artificial Sequence
  Synthetic
ccgttttttttttttggttacgc

SEQ ID NO: 13039 - DNA, 23 bp, Artificial Sequence
  Synthetic
ccgttttttttttttacatccct

SEQ ID NO: 13040 - DNA, 23 bp, Artificial Sequence
  Synthetic
ccgttttttttttttactctttc

SEQ ID NO: 13041 - DNA, 23 bp, Artificial Sequence
  Synthetic
ccgttttttttttttggaaacac

SEQ ID NO: 13042 - DNA, 23 bp, Artificial Sequence
  Synthetic
ccgttttttttttttactaccca

SEQ ID NO: 13043 - DNA, 23 bp, Artificial Sequence
  Synthetic
ccgttttttttttttctatgcca

SEQ ID NO: 13044 - DNA, 23 bp, Artificial Sequence
  Synthetic
ccgttttttttttttctgaactg

SEQ ID NO: 13045 - DNA, 23 bp, Artificial Sequence
  Synthetic
ccgttttttttttttagactgcc

SEQ ID NO: 13046 - DNA, 23 bp, Artificial Sequence
  Synthetic
ccgttttttttttttaagccggt

SEQ ID NO: 13047 - DNA, 23 bp, Artificial Sequence
  Synthetic
ccgttttttttttttaaggcttc

SEQ ID NO: 13048 - DNA, 23 bp, Artificial Sequence
  Synthetic
ccgttttttttttttgacagcta

SEQ ID NO: 13049 - DNA, 23 bp, Artificial Sequence
  Synthetic
ccgttttttttttttcacaaaca

SEQ ID NO: 13050 - DNA, 23 bp, Artificial Sequence
  Synthetic
ccgttttttttttttgctttggt

SEQ ID NO: 13051 - DNA, 23 bp, Artificial Sequence
  Synthetic
ccgttttttttttttggctttca

SEQ ID NO: 13052 - DNA, 23 bp, Artificial Sequence
  Synthetic
ccgttttttttttttctagcttt

SEQ ID NO: 13053 - DNA, 23 bp, Artificial Sequence
  Synthetic
ccgttttttttttttctggcttt

SEQ ID NO: 13054 - DNA, 23 bp, Artificial Sequence
  Synthetic
ccgttttttttttttctgaattt

SEQ ID NO: 13055 - DNA, 23 bp, Artificial Sequence
  Synthetic
ccgttttttttttttcaatatta

SEQ ID NO: 13056 - DNA, 23 bp, Artificial Sequence
  Synthetic
ccgttttttttttttcacgactt

SEQ ID NO: 13057 - DNA, 23 bp, Artificial Sequence
  Synthetic
ccgttttttttttttactgtggc

SEQ ID NO: 13058 - DNA, 23 bp, Artificial Sequence
  Synthetic
ccgttttttttttttcacctgaa

SEQ ID NO: 13059 - DNA, 23 bp, Artificial Sequence
  Synthetic
ccgttttttttttttgggcattc

SEQ ID NO: 13060 - DNA, 23 bp, Artificial Sequence
  Synthetic
ccgttttttttttttaaggattt

SEQ ID NO: 13061 - DNA, 23 bp, Artificial Sequence
  Synthetic
ccgttttttttttttcggcatta

SEQ ID NO: 13062 - DNA, 23 bp, Artificial Sequence
  Synthetic
ccgttttttttttttgggacatc

SEQ ID NO: 13063 - DNA, 23 bp, Artificial Sequence
  Synthetic
ccgttttttttttttccagctaa

SEQ ID NO: 13064 - DNA, 23 bp, Artificial Sequence
  Synthetic
ccgttttttttttttaggaacac

SEQ ID NO: 13065 - DNA, 23 bp, Artificial Sequence
  Synthetic
ccgttttttttttttatcagctt

SEQ ID NO: 13066 - DNA, 23 bp, Artificial Sequence
  Synthetic
ccgttttttttttttctatacaa

SEQ ID NO: 13067 - DNA, 23 bp, Artificial Sequence
  Synthetic
ccgttttttttttttccatactt

SEQ ID NO: 13068 - DNA, 23 bp, Artificial Sequence
  Synthetic
ccgttttttttttttcaaattcg

SEQ ID NO: 13069 - DNA, 23 bp, Artificial Sequence
  Synthetic
ccgttttttttttttacaagttc

SEQ ID NO: 13070 - DNA, 23 bp, Artificial Sequence
  Synthetic
ccgttttttttttttcaagaact

SEQ ID NO: 13071 - DNA, 23 bp, Artificial Sequence
  Synthetic
ccgttttttttttttccagtacc

SEQ ID NO: 13072 - DNA, 23 bp, Artificial Sequence
  Synthetic
ccgttttttttttttggcattca

SEQ ID NO: 13073 - DNA, 23 bp, Artificial Sequence
  Synthetic
ccgttttttttttttacaagtta

SEQ ID NO: 13074 - DNA, 23 bp, Artificial Sequence
  Synthetic
ccgttttttttttttcagctggt

SEQ ID NO: 13075 - DNA, 23 bp, Artificial Sequence
  Synthetic
ccgttttttttttttctcatcaa

SEQ ID NO: 13076 - DNA, 23 bp, Artificial Sequence
  Synthetic
ccgttttttttttttctcgtcaa

SEQ ID NO: 13077 - DNA, 23 bp, Artificial Sequence
  Synthetic
ccgttttttttttttggagagag

SEQ ID NO: 13078 - DNA, 23 bp, Artificial Sequence
  Synthetic
ccgttttttttttttcccttatc

SEQ ID NO: 13079 - DNA, 23 bp, Artificial Sequence
  Synthetic
ccgttttttttttttggggcgag

SEQ ID NO: 13080 - DNA, 23 bp, Artificial Sequence
  Synthetic
ccgttttttttttttgccgctgt

SEQ ID NO: 13081 - DNA, 23 bp, Artificial Sequence
  Synthetic
ccgttttttttttttaagaattg

SEQ ID NO: 13082 - DNA, 23 bp, Artificial Sequence
  Synthetic
ccgttttttttttttgaattctt

SEQ ID NO: 13083 - DNA, 23 bp, Artificial Sequence
  Synthetic
ccgttttttttttttgaattctc

SEQ ID NO: 13084 - DNA, 23 bp, Artificial Sequence
  Synthetic
ccgttttttttttttacccgtta

SEQ ID NO: 13085 - DNA, 23 bp, Artificial Sequence
  Synthetic
ccgttttttttttttgcgcgcta

SEQ ID NO: 13086 - DNA, 23 bp, Artificial Sequence
  Synthetic
ccgttttttttttttgtaggaac

SEQ ID NO: 13087 - DNA, 23 bp, Artificial Sequence
  Synthetic
ccgttttttttttttgagcacgg

SEQ ID NO: 13088 - DNA, 23 bp, Artificial Sequence
  Synthetic
ccgttttttttttttgagcacgg

SEQ ID NO: 13089 - DNA, 23 bp, Artificial Sequence
  Synthetic
ccgttttttttttttcgtaccag

SEQ ID NO: 13090 - DNA, 23 bp, Artificial Sequence
  Synthetic
ccgttttttttttttaacggacg

SEQ ID NO: 13091 - DNA, 23 bp, Artificial Sequence
  Synthetic
ccgttttttttttttatgagtgt

SEQ ID NO: 13092 - DNA, 23 bp, Artificial Sequence
  Synthetic
ccgttttttttttttcatttcat

SEQ ID NO: 13093 - DNA, 23 bp, Artificial Sequence
  Synthetic
ccgttttttttttttcaaagaga

SEQ ID NO: 13094 - DNA, 23 bp, Artificial Sequence
  Synthetic
ccgttttttttttttctgtcgac

SEQ ID NO: 13095 - DNA, 23 bp, Artificial Sequence
  Synthetic
ccgttttttttttttctgtcgac

SEQ ID NO: 13096 - DNA, 23 bp, Artificial Sequence
  Synthetic
ccgttttttttttttcagacaaa

SEQ ID NO: 13097 - DNA, 23 bp, Artificial Sequence
  Synthetic
ccgttttttttttttgaattacc

SEQ ID NO: 13098 - DNA, 23 bp, Artificial Sequence
  Synthetic
ccgttttttttttttaattgctg

SEQ ID NO: 13099 - DNA, 23 bp, Artificial Sequence
  Synthetic
ccgttttttttttttcactgatt

SEQ ID NO: 13100 - DNA, 23 bp, Artificial Sequence
  Synthetic
ccgttttttttttttgcacgagt

SEQ ID NO: 13101 - DNA, 23 bp, Artificial Sequence
  Synthetic
ccgttttttttttttgcaaacga

SEQ ID NO: 13102 - DNA, 23 bp, Artificial Sequence
  Synthetic
ccgttttttttttttatgaaatg

SEQ ID NO: 13103 - DNA, 23 bp, Artificial Sequence
  Synthetic
ccgttttttttttttgtcgcagg

SEQ ID NO: 13104 - DNA, 23 bp, Artificial Sequence
  Synthetic
ccgttttttttttttctcatcaa

SEQ ID NO: 13105 - DNA, 23 bp, Artificial Sequence
  Synthetic
ccgttttttttttttctcctcaa

SEQ ID NO: 13106 - DNA, 23 bp, Artificial Sequence
  Synthetic
ccgttttttttttttcccatcaa

SEQ ID NO: 13107 - DNA, 23 bp, Artificial Sequence
  Synthetic
ccgttttttttttttagacacac

SEQ ID NO: 13108 - DNA, 23 bp, Artificial Sequence
  Synthetic
ccgttttttttttttccagtttc

SEQ ID NO: 13109 - DNA, 23 bp, Artificial Sequence
  Synthetic
ccgttttttttttttcacattta

SEQ ID NO: 13110 - DNA, 23 bp, Artificial Sequence
  Synthetic
ccgttttttttttttagagcacc

SEQ ID NO: 13111 - DNA, 23 bp, Artificial Sequence
  Synthetic
ccgttttttttttttagagtcac

SEQ ID NO: 13112 - DNA, 23 bp, Artificial Sequence
  Synthetic
ccgttttttttttttcacaggca

SEQ ID NO: 13113 - DNA, 23 bp, Artificial Sequence
  Synthetic
ccgttttttttttttcactcaag

SEQ ID NO: 13114 - DNA, 23 bp, Artificial Sequence
  Synthetic
ccgttttttttttttcacagtat

SEQ ID NO: 13115 - DNA, 23 bp, Artificial Sequence
  Synthetic
ccgttttttttttttggacaaac

SEQ ID NO: 13116 - DNA, 23 bp, Artificial Sequence
  Synthetic
ccgttttttttttttaaggccgg

SEQ ID NO: 13117 - DNA, 23 bp, Artificial Sequence
  Synthetic
ccgttttttttttttaggccggt

SEQ ID NO: 13118 - DNA, 23 bp, Artificial Sequence
  Synthetic
ccgttttttttttttaggccgtc

SEQ ID NO: 13119 - DNA, 23 bp, Artificial Sequence
  Synthetic
ccgttttttttttttgggctgtg

SEQ ID NO: 13120 - DNA, 23 bp, Artificial Sequence
  Synthetic
ccgttttttttttttcgaactta

SEQ ID NO: 13121 - DNA, 23 bp, Artificial Sequence
  Synthetic
ccgttttttttttttctttctga

SEQ ID NO: 13122 - DNA, 23 bp, Artificial Sequence
  Synthetic
ccgttttttttttttgccagtaa

SEQ ID NO: 13123 - DNA, 23 bp, Artificial Sequence
  Synthetic
ccgttttttttttttctggatac

SEQ ID NO: 13124 - DNA, 23 bp, Artificial Sequence
  Synthetic
ccgttttttttttttagataaac

SEQ ID NO: 13125 - DNA, 23 bp, Artificial Sequence
  Synthetic
ccgttttttttttttagctatgc

SEQ ID NO: 13126 - DNA, 23 bp, Artificial Sequence
  Synthetic
ccgttttttttttttagctattc

SEQ ID NO: 13127 - DNA, 23 bp, Artificial Sequence
  Synthetic
ccgttttttttttttaatgcgac

SEQ ID NO: 13128 - DNA, 23 bp, Artificial Sequence
  Synthetic
ccgttttttttttttaaccagct

SEQ ID NO: 13129 - DNA, 23 bp, Artificial Sequence
  Synthetic
ccgttttttttttttaatggttg

SEQ ID NO: 13130 - DNA, 23 bp, Artificial Sequence
  Synthetic
ccgttttttttttttatatcaca

SEQ ID NO: 13131 - DNA, 23 bp, Artificial Sequence
  Synthetic
ccgttttttttttttaaaagaac

SEQ ID NO: 13132 - DNA, 23 bp, Artificial Sequence
  Synthetic
ccgttttttttttttcaacaaaa

SEQ ID NO: 13133 - DNA, 23 bp, Artificial Sequence
  Synthetic
ccgttttttttttttgctttggt

SEQ ID NO: 13134 - DNA, 23 bp, Artificial Sequence
  Synthetic
ccgttttttttttttacatcttt

SEQ ID NO: 13135 - DNA, 23 bp, Artificial Sequence
  Synthetic
ccgttttttttttttacacctga

SEQ ID NO: 13136 - DNA, 23 bp, Artificial Sequence
  Synthetic
ccgttttttttttttaggccggg

SEQ ID NO: 13137 - DNA, 23 bp, Artificial Sequence
  Synthetic
ccgttttttttttttcaggccgg

SEQ ID NO: 13138 - DNA, 23 bp, Artificial Sequence
  Synthetic
ccgttttttttttttatacagct

SEQ ID NO: 13139 - DNA, 23 bp, Artificial Sequence
  Synthetic
ccgttttttttttttatacagct

SEQ ID NO: 13140 - DNA, 23 bp, Artificial Sequence
  Synthetic
ccgttttttttttttacagctag

SEQ ID NO: 13141 - DNA, 23 bp, Artificial Sequence
  Synthetic
ccgttttttttttttacgtatac

SEQ ID NO: 13142 - DNA, 23 bp, Artificial Sequence
  Synthetic
ccgttttttttttttaggataca

SEQ ID NO: 13143 - DNA, 23 bp, Artificial Sequence
  Synthetic
ccgttttttttttttatcagctt

SEQ ID NO: 13144 - DNA, 23 bp, Artificial Sequence
  Synthetic
ccgttttttttttttctatacaa

SEQ ID NO: 13145 - DNA, 23 bp, Artificial Sequence
  Synthetic
ccgttttttttttttccatactt

SEQ ID NO: 13146 - DNA, 23 bp, Artificial Sequence
  Synthetic
ccgttttttttttttcaaattcg

SEQ ID NO: 13147 - DNA, 23 bp, Artificial Sequence
  Synthetic
ccgttttttttttttacaagttc

SEQ ID NO: 13148 - DNA, 23 bp, Artificial Sequence
  Synthetic
ccgttttttttttttcaagaact

SEQ ID NO: 13149 - DNA, 23 bp, Artificial Sequence
  Synthetic
ccgttttttttttttccagtacc

SEQ ID NO: 13150 - DNA, 23 bp, Artificial Sequence
  Synthetic
ccgttttttttttttggcattca

SEQ ID NO: 13151 - DNA, 23 bp, Artificial Sequence
  Synthetic
ccgttttttttttttacaagtta

SEQ ID NO: 13152 - DNA, 23 bp, Artificial Sequence
  Synthetic
ccgttttttttttttcagctggt

SEQ ID NO: 13153 - DNA, 23 bp, Artificial Sequence
  Synthetic
ccgttttttttttttctcatcaa

SEQ ID NO: 13154 - DNA, 23 bp, Artificial Sequence
  Synthetic
ccgttttttttttttctcgtcaa

SEQ ID NO: 13155 - DNA, 23 bp, Artificial Sequence
  Synthetic
ccgttttttttttttggagagag

SEQ ID NO: 13156 - DNA, 23 bp, Artificial Sequence
  Synthetic
ccgttttttttttttcccttatc

SEQ ID NO: 13157 - DNA, 23 bp, Artificial Sequence
  Synthetic
ccgttttttttttttgccgctgt

SEQ ID NO: 13158 - DNA, 23 bp, Artificial Sequence
  Synthetic
ccgttttttttttttaagaattg

SEQ ID NO: 13159 - DNA, 23 bp, Artificial Sequence
  Synthetic
ccgttttttttttttgaattctt

SEQ ID NO: 13160 - DNA, 23 bp, Artificial Sequence
  Synthetic
ccgttttttttttttgaattctc

SEQ ID NO: 13161 - DNA, 23 bp, Artificial Sequence
  Synthetic
ccgttttttttttttacccgtta

SEQ ID NO: 13162 - DNA, 23 bp, Artificial Sequence
  Synthetic
ccgttttttttttttgcgcgcta

SEQ ID NO: 13163 - DNA, 23 bp, Artificial Sequence
  Synthetic
ccgttttttttttttgagcacgg

SEQ ID NO: 13164 - DNA, 23 bp, Artificial Sequence
  Synthetic
ccgttttttttttttgagcacgg

SEQ ID NO: 13165 - DNA, 23 bp, Artificial Sequence
  Synthetic
ccgttttttttttttcgtaccag

SEQ ID NO: 13166 - DNA, 23 bp, Artificial Sequence
  Synthetic
ccgttttttttttttaacggacg

SEQ ID NO: 13167 - DNA, 23 bp, Artificial Sequence
  Synthetic
ccgttttttttttttatgagtgt

SEQ ID NO: 13168 - DNA, 23 bp, Artificial Sequence
  Synthetic
ccgttttttttttttcatttcat

SEQ ID NO: 13169 - DNA, 23 bp, Artificial Sequence
  Synthetic
ccgttttttttttttcaaagaga

SEQ ID NO: 13170 - DNA, 23 bp, Artificial Sequence
  Synthetic
ccgttttttttttttcagacaaa

SEQ ID NO: 13171 - DNA, 23 bp, Artificial Sequence
  Synthetic
ccgttttttttttttgaattacc

SEQ ID NO: 13172 - DNA, 23 bp, Artificial Sequence
  Synthetic
ccgttttttttttttaattgctg

SEQ ID NO: 13173 - DNA, 23 bp, Artificial Sequence
  Synthetic
ccgttttttttttttcactgatt

SEQ ID NO: 13174 - DNA, 23 bp, Artificial Sequence
  Synthetic
ccgttttttttttttgcacgagt

SEQ ID NO: 13175 - DNA, 23 bp, Artificial Sequence
  Synthetic
ccgttttttttttttgcaaacga

SEQ ID NO: 13176 - DNA, 23 bp, Artificial Sequence
  Synthetic
ccgttttttttttttatgaaatg

SEQ ID NO: 13177 - DNA, 23 bp, Artificial Sequence
  Synthetic
ccgttttttttttttgtcgcagg

SEQ ID NO: 13178 - DNA, 23 bp, Artificial Sequence
  Synthetic
ccgttttttttttttctcatcaa

SEQ ID NO: 13179 - DNA, 23 bp, Artificial Sequence
  Synthetic
ccgttttttttttttctcctcaa

SEQ ID NO: 13180 - DNA, 23 bp, Artificial Sequence
  Synthetic
ccgttttttttttttcccatcaa

SEQ ID NO: 13181 - DNA, 23 bp, Artificial Sequence
  Synthetic
ccgttttttttttttagacacac

SEQ ID NO: 13182 - DNA, 23 bp, Artificial Sequence
  Synthetic
ccgttttttttttttcacattta

SEQ ID NO: 13183 - DNA, 23 bp, Artificial Sequence
  Synthetic
ccgttttttttttttagagcacc

SEQ ID NO: 13184 - DNA, 23 bp, Artificial Sequence
  Synthetic
ccgttttttttttttagagtcac

SEQ ID NO: 13185 - DNA, 23 bp, Artificial Sequence
  Synthetic
ccgttttttttttttcactcaag

SEQ ID NO: 13186 - DNA, 23 bp, Artificial Sequence
  Synthetic
ccgttttttttttttcacagtat

SEQ ID NO: 13187 - DNA, 23 bp, Artificial Sequence
  Synthetic
ccgttttttttttttagacaaac

SEQ ID NO: 13188 - DNA, 23 bp, Artificial Sequence
  Synthetic
ccgttttttttttttcgaactta

SEQ ID NO: 13189 - DNA, 23 bp, Artificial Sequence
  Synthetic
ccgttttttttttttctttctga

SEQ ID NO: 13190 - DNA, 23 bp, Artificial Sequence
  Synthetic
ccgttttttttttttgccagtaa

SEQ ID NO: 13191 - DNA, 23 bp, Artificial Sequence
  Synthetic
ccgttttttttttttggatacca

SEQ ID NO: 13192 - DNA, 23 bp, Artificial Sequence
  Synthetic
ccgttttttttttttagataaac

SEQ ID NO: 13193 - DNA, 23 bp, Artificial Sequence
  Synthetic
ccgttttttttttttagctatgc

SEQ ID NO: 13194 - DNA, 23 bp, Artificial Sequence
  Synthetic
ccgttttttttttttagctattc

SEQ ID NO: 13195 - DNA, 23 bp, Artificial Sequence
  Synthetic
ccgttttttttttttaatgcgac

SEQ ID NO: 13196 - DNA, 23 bp, Artificial Sequence
  Synthetic
ccgttttttttttttaaccagct

SEQ ID NO: 13197 - DNA, 23 bp, Artificial Sequence
  Synthetic
ccgttttttttttttaatggttg

SEQ ID NO: 13198 - DNA, 23 bp, Artificial Sequence
  Synthetic
ccgttttttttttttatatcaca

SEQ ID NO: 13199 - DNA, 23 bp, Artificial Sequence
  Synthetic
ccgttttttttttttaaaagaac

SEQ ID NO: 13200 - DNA, 23 bp, Artificial Sequence
  Synthetic
ccgttttttttttttcaacaaaa

SEQ ID NO: 13201 - DNA, 23 bp, Artificial Sequence
  Synthetic
ccgttttttttttttgctttggt

SEQ ID NO: 13202 - DNA, 23 bp, Artificial Sequence
  Synthetic
ccgttttttttttttacatcttt

SEQ ID NO: 13203 - DNA, 23 bp, Artificial Sequence
  Synthetic
ccgttttttttttttacacctga

SEQ ID NO: 13204 - DNA, 23 bp, Artificial Sequence
  Synthetic
ccgttttttttttttaggccggg

SEQ ID NO: 13205 - DNA, 23 bp, Artificial Sequence
  Synthetic
ccgttttttttttttcaggccgg

SEQ ID NO: 13206 - DNA, 23 bp, Artificial Sequence
  Synthetic
ccgttttttttttttatacagct

SEQ ID NO: 13207 - DNA, 23 bp, Artificial Sequence
  Synthetic
ccgttttttttttttatacagct

SEQ ID NO: 13208 - DNA, 23 bp, Artificial Sequence
  Synthetic
ccgttttttttttttacagctag

SEQ ID NO: 13209 - DNA, 23 bp, Artificial Sequence
  Synthetic
ccgttttttttttttacgtatac

SEQ ID NO: 13210 - DNA, 23 bp, Artificial Sequence
  Synthetic
ccgttttttttttttaggataca

SEQ ID NO: 13211 - DNA, 23 bp, Artificial Sequence
  Synthetic
ccgttttttttttttactataca

SEQ ID NO: 13212 - DNA, 23 bp, Artificial Sequence
  Synthetic
ccgttttttttttttaccacaca

SEQ ID NO: 13213 - DNA, 23 bp, Artificial Sequence
  Synthetic
ccgttttttttttttaccataca

SEQ ID NO: 13214 - DNA, 23 bp, Artificial Sequence
  Synthetic
ccgttttttttttttaccataca

SEQ ID NO: 13215 - DNA, 23 bp, Artificial Sequence
  Synthetic
ccgttttttttttttactattca

SEQ ID NO: 13216 - DNA, 23 bp, Artificial Sequence
  Synthetic
ccgttttttttttttactataca

SEQ ID NO: 13217 - DNA, 23 bp, Artificial Sequence
  Synthetic
ccgttttttttttttactataca

SEQ ID NO: 13218 - DNA, 23 bp, Artificial Sequence
  Synthetic
ccgttttttttttttacaacaca

SEQ ID NO: 13219 - DNA, 23 bp, Artificial Sequence
  Synthetic
ccgttttttttttttacagcaca

SEQ ID NO: 13220 - DNA, 23 bp, Artificial Sequence
  Synthetic
ccgttttttttttttactgtaca

SEQ ID NO: 13221 - DNA, 23 bp, Artificial Sequence
  Synthetic
ccgttttttttttttacatactt

SEQ ID NO: 13222 - DNA, 23 bp, Artificial Sequence
  Synthetic
ccgttttttttttttacaagttc

SEQ ID NO: 13223 - DNA, 23 bp, Artificial Sequence
  Synthetic
ccgttttttttttttcagttatc

SEQ ID NO: 13224 - DNA, 23 bp, Artificial Sequence
  Synthetic
ccgttttttttttttcagttatc

SEQ ID NO: 13225 - DNA, 23 bp, Artificial Sequence
  Synthetic
ccgttttttttttttatagccct

SEQ ID NO: 13226 - DNA, 23 bp, Artificial Sequence
  Synthetic
ccgttttttttttttatagccct

SEQ ID NO: 13227 - DNA, 23 bp, Artificial Sequence
  Synthetic
ccgttttttttttttcaaattcg

SEQ ID NO: 13228 - DNA, 23 bp, Artificial Sequence
  Synthetic
ccgttttttttttttccccaaga

SEQ ID NO: 13229 - DNA, 23 bp, Artificial Sequence
  Synthetic
ccgttttttttttttacaaattc

SEQ ID NO: 13230 - DNA, 23 bp, Artificial Sequence
  Synthetic
ccgttttttttttttcaaatccg

SEQ ID NO: 13231 - DNA, 23 bp, Artificial Sequence
  Synthetic
ccgttttttttttttacacattc

SEQ ID NO: 13232 - DNA, 23 bp, Artificial Sequence
  Synthetic
ccgttttttttttttctccccta

SEQ ID NO: 13233 - DNA, 23 bp, Artificial Sequence
  Synthetic
ccgttttttttttttaaacacca

SEQ ID NO: 13234 - DNA, 23 bp, Artificial Sequence
  Synthetic
ccgttttttttttttgcattcac

SEQ ID NO: 13235 - DNA, 23 bp, Artificial Sequence
  Synthetic
ccgttttttttttttacaggtta

SEQ ID NO: 13236 - DNA, 23 bp, Artificial Sequence
  Synthetic
ccgttttttttttttacaagtta

SEQ ID NO: 13237 - DNA, 23 bp, Artificial Sequence
  Synthetic
ccgttttttttttttacgagtta

SEQ ID NO: 13238 - DNA, 23 bp, Artificial Sequence
  Synthetic
ccgttttttttttttcattatta

SEQ ID NO: 13239 - DNA, 23 bp, Artificial Sequence
  Synthetic
ccgttttttttttttgcgtacca

SEQ ID NO: 13240 - DNA, 23 bp, Artificial Sequence
  Synthetic
ccgttttttttttttaaagagac

SEQ ID NO: 13241 - DNA, 23 bp, Artificial Sequence
  Synthetic
ccgttttttttttttgcaagccc

SEQ ID NO: 13242 - DNA, 23 bp, Artificial Sequence
  Synthetic
ccgttttttttttttgctttttg

SEQ ID NO: 13243 - DNA, 23 bp, Artificial Sequence
  Synthetic
ccgttttttttttttgccctttt

SEQ ID NO: 13244 - DNA, 23 bp, Artificial Sequence
  Synthetic
ccgttttttttttttgccctttc

SEQ ID NO: 13245 - DNA, 23 bp, Artificial Sequence
  Synthetic
ccgttttttttttttgccctttt

SEQ ID NO: 13246 - DNA, 23 bp, Artificial Sequence
  Synthetic
ccgttttttttttttgaccatgg

SEQ ID NO: 13247 - DNA, 23 bp, Artificial Sequence
  Synthetic
ccgttttttttttttgtaacaat

SEQ ID NO: 13248 - DNA, 23 bp, Artificial Sequence
  Synthetic
ccgttttttttttttagctggtt

SEQ ID NO: 13249 - DNA, 23 bp, Artificial Sequence
  Synthetic
ccgttttttttttttggttccat

SEQ ID NO: 13250 - DNA, 23 bp, Artificial Sequence
  Synthetic
ccgttttttttttttgctggttg

SEQ ID NO: 13251 - DNA, 23 bp, Artificial Sequence
  Synthetic
ccgttttttttttttacttggtt

SEQ ID NO: 13252 - DNA, 23 bp, Artificial Sequence
  Synthetic
ccgttttttttttttgctggttg

SEQ ID NO: 13253 - DNA, 23 bp, Artificial Sequence
  Synthetic
ccgttttttttttttacatagga

SEQ ID NO: 13254 - DNA, 23 bp, Artificial Sequence
  Synthetic
ccgttttttttttttagatagga

SEQ ID NO: 13255 - DNA, 23 bp, Artificial Sequence
  Synthetic
ccgttttttttttttacatagga

SEQ ID NO: 13256 - DNA, 23 bp, Artificial Sequence
  Synthetic
ccgttttttttttttcgcgtatt

SEQ ID NO: 13257 - DNA, 23 bp, Artificial Sequence
  Synthetic
ccgttttttttttttgcctgatt

SEQ ID NO: 13258 - DNA, 23 bp, Artificial Sequence
  Synthetic
ccgttttttttttttgacacatg

SEQ ID NO: 13259 - DNA, 23 bp, Artificial Sequence
  Synthetic
ccgttttttttttttaccatagg

SEQ ID NO: 13260 - DNA, 23 bp, Artificial Sequence
  Synthetic
ccgttttttttttttccgtggtt

SEQ ID NO: 13261 - DNA, 23 bp, Artificial Sequence
  Synthetic
ccgttttttttttttcatcgtta

SEQ ID NO: 13262 - DNA, 23 bp, Artificial Sequence
  Synthetic
ccgttttttttttttcataaagt

SEQ ID NO: 13263 - DNA, 23 bp, Artificial Sequence
  Synthetic
ccgttttttttttttgtagtgct

SEQ ID NO: 13264 - DNA, 23 bp, Artificial Sequence
  Synthetic
ccgttttttttttttgtagtgct

SEQ ID NO: 13265 - DNA, 23 bp, Artificial Sequence
  Synthetic
ccgttttttttttttagctacag

SEQ ID NO: 13266 - DNA, 23 bp, Artificial Sequence
  Synthetic
ccgttttttttttttgtacatca

SEQ ID NO: 13267 - DNA, 23 bp, Artificial Sequence
  Synthetic
ccgttttttttttttggattcct

SEQ ID NO: 13268 - DNA, 23 bp, Artificial Sequence
  Synthetic
ccgttttttttttttcatctatg

SEQ ID NO: 13269 - DNA, 23 bp, Artificial Sequence
  Synthetic
ccgttttttttttttacccttgg

SEQ ID NO: 13270 - DNA, 23 bp, Artificial Sequence
  Synthetic
ccgttttttttttttcaaagttc

SEQ ID NO: 13271 - DNA, 23 bp, Artificial Sequence
  Synthetic
ccgttttttttttttactggtac

SEQ ID NO: 13272 - DNA, 23 bp, Artificial Sequence
  Synthetic
ccgttttttttttttcaaagttc

SEQ ID NO: 13273 - DNA, 23 bp, Artificial Sequence
  Synthetic
ccgttttttttttttatcacttt

SEQ ID NO: 13274 - DNA, 23 bp, Artificial Sequence
  Synthetic
ccgttttttttttttctcatttt

SEQ ID NO: 13275 - DNA, 23 bp, Artificial Sequence
  Synthetic
ccgttttttttttttatcatttt

SEQ ID NO: 13276 - DNA, 23 bp, Artificial Sequence
  Synthetic
ccgttttttttttttccctatca

SEQ ID NO: 13277 - DNA, 23 bp, Artificial Sequence
  Synthetic
ccgttttttttttttacaaacca

SEQ ID NO: 13278 - DNA, 23 bp, Artificial Sequence
  Synthetic
ccgttttttttttttccgcagca

SEQ ID NO: 13279 - DNA, 23 bp, Artificial Sequence
  Synthetic
ccgttttttttttttcaaaccat

SEQ ID NO: 13280 - DNA, 23 bp, Artificial Sequence
  Synthetic
ccgttttttttttttaaaaccat

SEQ ID NO: 13281 - DNA, 23 bp, Artificial Sequence
  Synthetic
ccgttttttttttttaccaatat

SEQ ID NO: 13282 - DNA, 23 bp, Artificial Sequence
  Synthetic
ccgttttttttttttccaatatt

SEQ ID NO: 13283 - DNA, 23 bp, Artificial Sequence
  Synthetic
ccgttttttttttttccaatatt

SEQ ID NO: 13284 - DNA, 23 bp, Artificial Sequence
  Synthetic
ccgttttttttttttcctgcact

SEQ ID NO: 13285 - DNA, 23 bp, Artificial Sequence
  Synthetic
ccgttttttttttttagaagtgc

SEQ ID NO: 13286 - DNA, 23 bp, Artificial Sequence
  Synthetic
ccgttttttttttttctcaccga

SEQ ID NO: 13287 - DNA, 23 bp, Artificial Sequence
  Synthetic
ccgttttttttttttgtacaatc

SEQ ID NO: 13288 - DNA, 23 bp, Artificial Sequence
  Synthetic
ccgttttttttttttccaccgac

SEQ ID NO: 13289 - DNA, 23 bp, Artificial Sequence
  Synthetic
ccgttttttttttttccaccgac

SEQ ID NO: 13290 - DNA, 23 bp, Artificial Sequence
  Synthetic
ccgttttttttttttgagttcta

SEQ ID NO: 13291 - DNA, 23 bp, Artificial Sequence
  Synthetic
ccgttttttttttttgttggcaa

SEQ ID NO: 13292 - DNA, 23 bp, Artificial Sequence
  Synthetic
ccgttttttttttttagtgaatt

SEQ ID NO: 13293 - DNA, 23 bp, Artificial Sequence
  Synthetic
ccgttttttttttttcccttatc

SEQ ID NO: 13294 - DNA, 23 bp, Artificial Sequence
  Synthetic
ccgttttttttttttgctgcaac

SEQ ID NO: 13295 - DNA, 23 bp, Artificial Sequence
  Synthetic
ccgttttttttttttctgcacta

SEQ ID NO: 13296 - DNA, 23 bp, Artificial Sequence
  Synthetic
ccgttttttttttttctgcacta

SEQ ID NO: 13297 - DNA, 23 bp, Artificial Sequence
  Synthetic
ccgttttttttttttcagaaggg

SEQ ID NO: 13298 - DNA, 23 bp, Artificial Sequence
  Synthetic
ccgttttttttttttactacaca

SEQ ID NO: 13299 - DNA, 23 bp, Artificial Sequence
  Synthetic
ccgttttttttttttcctaatat

SEQ ID NO: 13300 - DNA, 23 bp, Artificial Sequence
  Synthetic
ccgttttttttttttaaccgaat

SEQ ID NO: 13301 - DNA, 23 bp, Artificial Sequence
  Synthetic
ccgttttttttttttgctgtcaa

SEQ ID NO: 13302 - DNA, 23 bp, Artificial Sequence
  Synthetic
ccgttttttttttttctgggact

SEQ ID NO: 13303 - DNA, 23 bp, Artificial Sequence
  Synthetic
ccgttttttttttttgcgggact

SEQ ID NO: 13304 - DNA, 23 bp, Artificial Sequence
  Synthetic
ccgttttttttttttcacatgga

SEQ ID NO: 13305 - DNA, 23 bp, Artificial Sequence
  Synthetic
ccgttttttttttttcacatgga

SEQ ID NO: 13306 - DNA, 23 bp, Artificial Sequence
  Synthetic
ccgttttttttttttccaacaac

SEQ ID NO: 13307 - DNA, 23 bp, Artificial Sequence
  Synthetic
ccgttttttttttttccaacaac

SEQ ID NO: 13308 - DNA, 23 bp, Artificial Sequence
  Synthetic
ccgttttttttttttaacaggta

SEQ ID NO: 13309 - DNA, 23 bp, Artificial Sequence
  Synthetic
ccgttttttttttttaccaatgt

SEQ ID NO: 13310 - DNA, 23 bp, Artificial Sequence
  Synthetic
ccgttttttttttttagttttgc

SEQ ID NO: 13311 - DNA, 23 bp, Artificial Sequence
  Synthetic
ccgttttttttttttgtgcaact

SEQ ID NO: 13312 - DNA, 23 bp, Artificial Sequence
  Synthetic
ccgttttttttttttagttttgc

SEQ ID NO: 13313 - DNA, 23 bp, Artificial Sequence
  Synthetic
ccgttttttttttttgaatgcaa

SEQ ID NO: 13314 - DNA, 23 bp, Artificial Sequence
  Synthetic
ccgttttttttttttgagttttg

SEQ ID NO: 13315 - DNA, 23 bp, Artificial Sequence
  Synthetic
ccgttttttttttttagttttgc

SEQ ID NO: 13316 - DNA, 23 bp, Artificial Sequence
  Synthetic
ccgttttttttttttcatcgtta

SEQ ID NO: 13317 - DNA, 23 bp, Artificial Sequence
  Synthetic
ccgttttttttttttatcattac

SEQ ID NO: 13318 - DNA, 23 bp, Artificial Sequence
  Synthetic
ccgttttttttttttcatcatta

SEQ ID NO: 13319 - DNA, 23 bp, Artificial Sequence
  Synthetic
ccgttttttttttttccatgccc

SEQ ID NO: 13320 - DNA, 23 bp, Artificial Sequence
  Synthetic
ccgttttttttttttaaagaggt

SEQ ID NO: 13321 - DNA, 23 bp, Artificial Sequence
  Synthetic
ccgttttttttttttaagtggtc

SEQ ID NO: 13322 - DNA, 23 bp, Artificial Sequence
  Synthetic
ccgttttttttttttaagtggtc

SEQ ID NO: 13323 - DNA, 23 bp, Artificial Sequence
  Synthetic
ccgttttttttttttgaactgtt

SEQ ID NO: 13324 - DNA, 23 bp, Artificial Sequence
  Synthetic
ccgttttttttttttggcatagg

SEQ ID NO: 13325 - DNA, 23 bp, Artificial Sequence
  Synthetic
ccgttttttttttttagactccg

SEQ ID NO: 13326 - DNA, 23 bp, Artificial Sequence
  Synthetic
ccgttttttttttttcacacact

SEQ ID NO: 13327 - DNA, 23 bp, Artificial Sequence
  Synthetic
ccgttttttttttttacctgcac

SEQ ID NO: 13328 - DNA, 23 bp, Artificial Sequence
  Synthetic
ccgttttttttttttcaagtgct

SEQ ID NO: 13329 - DNA, 23 bp, Artificial Sequence
  Synthetic
ccgttttttttttttacctgcac

SEQ ID NO: 13330 - DNA, 23 bp, Artificial Sequence
  Synthetic
ccgttttttttttttccaacacc

SEQ ID NO: 13331 - DNA, 23 bp, Artificial Sequence
  Synthetic
ccgttttttttttttgccgctgt

SEQ ID NO: 13332 - DNA, 23 bp, Artificial Sequence
  Synthetic
ccgttttttttttttaatgtgcg

SEQ ID NO: 13333 - DNA, 23 bp, Artificial Sequence
  Synthetic
ccgttttttttttttgccatgac

SEQ ID NO: 13334 - DNA, 23 bp, Artificial Sequence
  Synthetic
ccgttttttttttttgcctgtct

SEQ ID NO: 13335 - DNA, 23 bp, Artificial Sequence
  Synthetic
ccgttttttttttttacagttgc

SEQ ID NO: 13336 - DNA, 23 bp, Artificial Sequence
  Synthetic
ccgttttttttttttacagttgc

SEQ ID NO: 13337 - DNA, 23 bp, Artificial Sequence
  Synthetic
ccgttttttttttttcaatcagt

SEQ ID NO: 13338 - DNA, 23 bp, Artificial Sequence
  Synthetic
ccgttttttttttttacatggtt

SEQ ID NO: 13339 - DNA, 23 bp, Artificial Sequence
  Synthetic
ccgttttttttttttcatggtta

SEQ ID NO: 13340 - DNA, 23 bp, Artificial Sequence
  Synthetic
ccgttttttttttttagaattgc

SEQ ID NO: 13341 - DNA, 23 bp, Artificial Sequence
  Synthetic
ccgttttttttttttagtgtccg

SEQ ID NO: 13342 - DNA, 23 bp, Artificial Sequence
  Synthetic
ccgttttttttttttaaacccag

SEQ ID NO: 13343 - DNA, 23 bp, Artificial Sequence
  Synthetic
ccgttttttttttttagacccag

SEQ ID NO: 13344 - DNA, 23 bp, Artificial Sequence
  Synthetic
ccgttttttttttttgggtattt

SEQ ID NO: 13345 - DNA, 23 bp, Artificial Sequence
  Synthetic
ccgttttttttttttcagttctt

SEQ ID NO: 13346 - DNA, 23 bp, Artificial Sequence
  Synthetic
ccgttttttttttttcagctctt

SEQ ID NO: 13347 - DNA, 23 bp, Artificial Sequence
  Synthetic
ccgttttttttttttgaaatccc

SEQ ID NO: 13348 - DNA, 23 bp, Artificial Sequence
  Synthetic
ccgttttttttttttgtaatccc

SEQ ID NO: 13349 - DNA, 23 bp, Artificial Sequence
  Synthetic
ccgttttttttttttgttcctgc

SEQ ID NO: 13350 - DNA, 23 bp, Artificial Sequence
  Synthetic
ccgttttttttttttagaccgag

SEQ ID NO: 13351 - DNA, 23 bp, Artificial Sequence
  Synthetic
ccgttttttttttttgcctatcc

SEQ ID NO: 13352 - DNA, 23 bp, Artificial Sequence
  Synthetic
ccgttttttttttttacctatcc

SEQ ID NO: 13353 - DNA, 23 bp, Artificial Sequence
  Synthetic
ccgttttttttttttgcggaact

SEQ ID NO: 13354 - DNA, 23 bp, Artificial Sequence
  Synthetic
ccgttttttttttttcagaactt

SEQ ID NO: 13355 - DNA, 23 bp, Artificial Sequence
  Synthetic
ccgttttttttttttcagaactt

SEQ ID NO: 13356 - DNA, 23 bp, Artificial Sequence
  Synthetic
ccgttttttttttttattgttca

SEQ ID NO: 13357 - DNA, 23 bp, Artificial Sequence
  Synthetic
ccgttttttttttttaagaactt

SEQ ID NO: 13358 - DNA, 23 bp, Artificial Sequence
  Synthetic
ccgttttttttttttactgaact

SEQ ID NO: 13359 - DNA, 23 bp, Artificial Sequence
  Synthetic
ccgttttttttttttaccgattt

SEQ ID NO: 13360 - DNA, 23 bp, Artificial Sequence
  Synthetic
ccgttttttttttttcactgatt

SEQ ID NO: 13361 - DNA, 23 bp, Artificial Sequence
  Synthetic
ccgttttttttttttgacaatac

SEQ ID NO: 13362 - DNA, 23 bp, Artificial Sequence
  Synthetic
ccgttttttttttttaatgacaa

SEQ ID NO: 13363 - DNA, 23 bp, Artificial Sequence
  Synthetic
ccgttttttttttttatgacaat

SEQ ID NO: 13364 - DNA, 23 bp, Artificial Sequence
  Synthetic
ccgttttttttttttccagtcgg

SEQ ID NO: 13365 - DNA, 23 bp, Artificial Sequence
  Synthetic
ccgttttttttttttgctgagtg

SEQ ID NO: 13366 - DNA, 23 bp, Artificial Sequence
  Synthetic
ccgttttttttttttgagagtgt

SEQ ID NO: 13367 - DNA, 23 bp, Artificial Sequence
  Synthetic
ccgttttttttttttccagtcgg

SEQ ID NO: 13368 - DNA, 23 bp, Artificial Sequence
  Synthetic
ccgttttttttttttccagtcaa

SEQ ID NO: 13369 - DNA, 23 bp, Artificial Sequence
  Synthetic
ccgttttttttttttctgcaaac

SEQ ID NO: 13370 - DNA, 23 bp, Artificial Sequence
  Synthetic
ccgttttttttttttagctatgc

SEQ ID NO: 13371 - DNA, 23 bp, Artificial Sequence
  Synthetic
ccgttttttttttttaacaaaat

SEQ ID NO: 13372 - DNA, 23 bp, Artificial Sequence
  Synthetic
ccgttttttttttttcaaccagc

SEQ ID NO: 13373 - DNA, 23 bp, Artificial Sequence
  Synthetic
ccgttttttttttttaatcagct

SEQ ID NO: 13374 - DNA, 23 bp, Artificial Sequence
  Synthetic
ccgttttttttttttaatcaact

SEQ ID NO: 13375 - DNA, 23 bp, Artificial Sequence
  Synthetic
ccgttttttttttttcagatgga

SEQ ID NO: 13376 - DNA, 23 bp, Artificial Sequence
  Synthetic
ccgttttttttttttaaggattt

SEQ ID NO: 13377 - DNA, 23 bp, Artificial Sequence
  Synthetic
ccgttttttttttttacgcgagc

SEQ ID NO: 13378 - DNA, 23 bp, Artificial Sequence
  Synthetic
ccgttttttttttttcggcatta

SEQ ID NO: 13379 - DNA, 23 bp, Artificial Sequence
  Synthetic
ccgttttttttttttaccccaac

SEQ ID NO: 13380 - DNA, 23 bp, Artificial Sequence
  Synthetic
ccgttttttttttttaccccaac

SEQ ID NO: 13381 - DNA, 23 bp, Artificial Sequence
  Synthetic
ccgttttttttttttaccccaaa

SEQ ID NO: 13382 - DNA, 23 bp, Artificial Sequence
  Synthetic
ccgttttttttttttacgccaac

SEQ ID NO: 13383 - DNA, 23 bp, Artificial Sequence
  Synthetic
ccgttttttttttttccccaatt

SEQ ID NO: 13384 - DNA, 23 bp, Artificial Sequence
  Synthetic
ccgttttttttttttactcagta

SEQ ID NO: 13385 - DNA, 23 bp, Artificial Sequence
  Synthetic
ccgttttttttttttcctattag

SEQ ID NO: 13386 - DNA, 23 bp, Artificial Sequence
  Synthetic
ccgttttttttttttcctataag

SEQ ID NO: 13387 - DNA, 23 bp, Artificial Sequence
  Synthetic
ccgttttttttttttgatgtagt

SEQ ID NO: 13388 - DNA, 23 bp, Artificial Sequence
  Synthetic
ccgttttttttttttacaaccat

SEQ ID NO: 13389 - DNA, 23 bp, Artificial Sequence
  Synthetic
ccgttttttttttttccaatatt

SEQ ID NO: 13390 - DNA, 23 bp, Artificial Sequence
  Synthetic
ccgttttttttttttccagtatt

SEQ ID NO: 13391 - DNA, 23 bp, Artificial Sequence
  Synthetic
ccgttttttttttttcagtacca

SEQ ID NO: 13392 - DNA, 23 bp, Artificial Sequence
  Synthetic
ccgttttttttttttaggatgaa

SEQ ID NO: 13393 - DNA, 23 bp, Artificial Sequence
  Synthetic
ccgttttttttttttcccagtaa

SEQ ID NO: 13394 - DNA, 23 bp, Artificial Sequence
  Synthetic
ccgttttttttttttatccacat

SEQ ID NO: 13395 - DNA, 23 bp, Artificial Sequence
  Synthetic
ccgttttttttttttgcacagtg

SEQ ID NO: 13396 - DNA, 23 bp, Artificial Sequence
  Synthetic
ccgttttttttttttgcatttag

SEQ ID NO: 13397 - DNA, 23 bp, Artificial Sequence
  Synthetic
ccgttttttttttttgctgcatt

SEQ ID NO: 13398 - DNA, 23 bp, Artificial Sequence
  Synthetic
ccgttttttttttttcagccgta

SEQ ID NO: 13399 - DNA, 23 bp, Artificial Sequence
  Synthetic
ccgttttttttttttaacatcac

SEQ ID NO: 13400 - DNA, 23 bp, Artificial Sequence
  Synthetic
ccgttttttttttttatctgaaa

SEQ ID NO: 13401 - DNA, 23 bp, Artificial Sequence
  Synthetic
ccgttttttttttttgcacagat

SEQ ID NO: 13402 - DNA, 23 bp, Artificial Sequence
  Synthetic
ccgttttttttttttaagtaaca

SEQ ID NO: 13403 - DNA, 23 bp, Artificial Sequence
  Synthetic
ccgttttttttttttacagtcgc

SEQ ID NO: 13404 - DNA, 23 bp, Artificial Sequence
  Synthetic
ccgttttttttttttctactaga

SEQ ID NO: 13405 - DNA, 23 bp, Artificial Sequence
  Synthetic
ccgttttttttttttcgagttct

SEQ ID NO: 13406 - DNA, 23 bp, Artificial Sequence
  Synthetic
ccgttttttttttttagtcttca

SEQ ID NO: 13407 - DNA, 23 bp, Artificial Sequence
  Synthetic
ccgttttttttttttctgggagg

SEQ ID NO: 13408 - DNA, 23 bp, Artificial Sequence
  Synthetic
ccgttttttttttttaaaacgta

SEQ ID NO: 13409 - DNA, 23 bp, Artificial Sequence
  Synthetic
ccgttttttttttttacccaggt

SEQ ID NO: 13410 - DNA, 23 bp, Artificial Sequence
  Synthetic
ccgttttttttttttcacacagc

SEQ ID NO: 13411 - DNA, 23 bp, Artificial Sequence
  Synthetic
ccgttttttttttttgatccggg

SEQ ID NO: 13412 - DNA, 23 bp, Artificial Sequence
  Synthetic
ccgttttttttttttccgagagt

SEQ ID NO: 13413 - DNA, 23 bp, Artificial Sequence
  Synthetic
ccgttttttttttttaccactga

SEQ ID NO: 13414 - DNA, 23 bp, Artificial Sequence
  Synthetic
ccgttttttttttttggtacgat

SEQ ID NO: 13415 - DNA, 23 bp, Artificial Sequence
  Synthetic
ccgttttttttttttcaagttta

SEQ ID NO: 13416 - DNA, 23 bp, Artificial Sequence
  Synthetic
ccgttttttttttttaaactttt

SEQ ID NO: 13417 - DNA, 23 bp, Artificial Sequence
  Synthetic
ccgttttttttttttctttaggt

SEQ ID NO: 13418 - DNA, 23 bp, Artificial Sequence
  Synthetic
ccgttttttttttttaggtcccg

SEQ ID NO: 13419 - DNA, 23 bp, Artificial Sequence
  Synthetic
ccgttttttttttttacccttct

SEQ ID NO: 13420 - DNA, 23 bp, Artificial Sequence
  Synthetic
ccgttttttttttttctgtacca

SEQ ID NO: 13421 - DNA, 23 bp, Artificial Sequence
  Synthetic
ccgttttttttttttcaacaaaa

SEQ ID NO: 13422 - DNA, 23 bp, Artificial Sequence
  Synthetic
ccgttttttttttttacaaaatc

SEQ ID NO: 13423 - DNA, 23 bp, Artificial Sequence
  Synthetic
ccgttttttttttttatacagct

SEQ ID NO: 13424 - DNA, 23 bp, Artificial Sequence
  Synthetic
ccgttttttttttttctttcggt

SEQ ID NO: 13425 - DNA, 23 bp, Artificial Sequence
  Synthetic
ccgttttttttttttcaggccgg

SEQ ID NO: 13426 - DNA, 23 bp, Artificial Sequence
  Synthetic
ccgttttttttttttgaggccgg

SEQ ID NO: 13427 - DNA, 23 bp, Artificial Sequence
  Synthetic
ccgttttttttttttcctgcaca

SEQ ID NO: 13428 - DNA, 23 bp, Artificial Sequence
  Synthetic
ccgttttttttttttgcaaaaat

SEQ ID NO: 13429 - DNA, 23 bp, Artificial Sequence
  Synthetic
ccgttttttttttttacaagatc

SEQ ID NO: 13430 - DNA, 23 bp, Artificial Sequence
  Synthetic
ccgttttttttttttgacatagt

SEQ ID NO: 13431 - DNA, 23 bp, Artificial Sequence
  Synthetic
ccgttttttttttttcagcacgt

SEQ ID NO: 13432 - DNA, 23 bp, Artificial Sequence
  Synthetic
ccgttttttttttttcagccaac

SEQ ID NO: 13433 - DNA, 23 bp, Artificial Sequence
  Synthetic
ccgttttttttttttgcagtcag

SEQ ID NO: 13434 - DNA, 23 bp, Artificial Sequence
  Synthetic
ccgttttttttttttcaactagc

SEQ ID NO: 13435 - DNA, 23 bp, Artificial Sequence
  Synthetic
ccgttttttttttttaaccacac

SEQ ID NO: 13436 - DNA, 23 bp, Artificial Sequence
  Synthetic
ccgttttttttttttagccgtcc

SEQ ID NO: 13437 - DNA, 23 bp, Artificial Sequence
  Synthetic
ccgttttttttttttccctacta

SEQ ID NO: 13438 - DNA, 23 bp, Artificial Sequence
  Synthetic
ccgttttttttttttaaatcggc

SEQ ID NO: 13439 - DNA, 23 bp, Artificial Sequence
  Synthetic
ccgttttttttttttatcaagga

SEQ ID NO: 13440 - DNA, 23 bp, Artificial Sequence
  Synthetic
ccgttttttttttttaagagcac

SEQ ID NO: 13441 - DNA, 23 bp, Artificial Sequence
  Synthetic
ccgttttttttttttaggggaca

SEQ ID NO: 13442 - DNA, 23 bp, Artificial Sequence
  Synthetic
ccgttttttttttttcttgtatg

SEQ ID NO: 13443 - DNA, 23 bp, Artificial Sequence
  Synthetic
ccgttttttttttttgtatagga

SEQ ID NO: 13444 - DNA, 23 bp, Artificial Sequence
  Synthetic
ccgttttttttttttcattccca

SEQ ID NO: 13445 - DNA, 23 bp, Artificial Sequence
  Synthetic
ccgttttttttttttcaagggcg

SEQ ID NO: 13446 - DNA, 23 bp, Artificial Sequence
  Synthetic
ccgttttttttttttgtaacagg

SEQ ID NO: 13447 - DNA, 23 bp, Artificial Sequence
  Synthetic
ccgttttttttttttgaatgaag

SEQ ID NO: 13448 - DNA, 23 bp, Artificial Sequence
  Synthetic
ccgttttttttttttcacctggt

SEQ ID NO: 13449 - DNA, 23 bp, Artificial Sequence
  Synthetic
ccgttttttttttttgcacaaca

SEQ ID NO: 13450 - DNA, 23 bp, Artificial Sequence
  Synthetic
ccgttttttttttttgcacacca

SEQ ID NO: 13451 - DNA, 23 bp, Artificial Sequence
  Synthetic
ccgttttttttttttgatgggca

SEQ ID NO: 13452 - DNA, 23 bp, Artificial Sequence
  Synthetic
ccgttttttttttttaaggctag

SEQ ID NO: 13453 - DNA, 23 bp, Artificial Sequence
  Synthetic
ccgttttttttttttagcctatg

SEQ ID NO: 13454 - DNA, 23 bp, Artificial Sequence
  Synthetic
ccgttttttttttttcctggaca

SEQ ID NO: 13455 - DNA, 23 bp, Artificial Sequence
  Synthetic
ccgttttttttttttacgacccc

SEQ ID NO: 13456 - DNA, 23 bp, Artificial Sequence
  Synthetic
ccgttttttttttttgtacaatc

SEQ ID NO: 13457 - DNA, 23 bp, Artificial Sequence
  Synthetic
ccgttttttttttttacgggacc

SEQ ID NO: 13458 - DNA, 23 bp, Artificial Sequence
  Synthetic
ccgttttttttttttactccggg

SEQ ID NO: 13459 - DNA, 23 bp, Artificial Sequence
  Synthetic
ccgttttttttttttaatttctg

SEQ ID NO: 13460 - DNA, 23 bp, Artificial Sequence
  Synthetic
ccgttttttttttttctatctgc

SEQ ID NO: 13461 - DNA, 23 bp, Artificial Sequence
  Synthetic
ccgttttttttttttgtgcttac

SEQ ID NO: 13462 - DNA, 23 bp, Artificial Sequence
  Synthetic
ccgttttttttttttactataca

SEQ ID NO: 13463 - DNA, 23 bp, Artificial Sequence
  Synthetic
ccgttttttttttttaccacaca

SEQ ID NO: 13464 - DNA, 23 bp, Artificial Sequence
  Synthetic
ccgttttttttttttaccataca

SEQ ID NO: 13465 - DNA, 23 bp, Artificial Sequence
  Synthetic
ccgttttttttttttactattca

SEQ ID NO: 13466 - DNA, 23 bp, Artificial Sequence
  Synthetic
ccgttttttttttttactataca

SEQ ID NO: 13467 - DNA, 23 bp, Artificial Sequence
  Synthetic
ccgttttttttttttacaacaca

SEQ ID NO: 13468 - DNA, 23 bp, Artificial Sequence
  Synthetic
ccgttttttttttttacagcaca

SEQ ID NO: 13469 - DNA, 23 bp, Artificial Sequence
  Synthetic
ccgttttttttttttactgtaca

SEQ ID NO: 13470 - DNA, 23 bp, Artificial Sequence
  Synthetic
ccgttttttttttttacatactt

SEQ ID NO: 13471 - DNA, 23 bp, Artificial Sequence
  Synthetic
ccgttttttttttttacaagttc

SEQ ID NO: 13472 - DNA, 23 bp, Artificial Sequence
  Synthetic
ccgttttttttttttcagttatc

SEQ ID NO: 13473 - DNA, 23 bp, Artificial Sequence
  Synthetic
ccgttttttttttttcagttatc

SEQ ID NO: 13474 - DNA, 23 bp, Artificial Sequence
  Synthetic
ccgttttttttttttatagccct

SEQ ID NO: 13475 - DNA, 23 bp, Artificial Sequence
  Synthetic
ccgttttttttttttatagccct

SEQ ID NO: 13476 - DNA, 23 bp, Artificial Sequence
  Synthetic
ccgttttttttttttacaaattc

SEQ ID NO: 13477 - DNA, 23 bp, Artificial Sequence
  Synthetic
ccgttttttttttttcaaatccg

SEQ ID NO: 13478 - DNA, 23 bp, Artificial Sequence
  Synthetic
ccgttttttttttttacacacat

SEQ ID NO: 13479 - DNA, 23 bp, Artificial Sequence
  Synthetic
ccgttttttttttttaaacacca

SEQ ID NO: 13480 - DNA, 23 bp, Artificial Sequence
  Synthetic
ccgttttttttttttgcattcac

SEQ ID NO: 13481 - DNA, 23 bp, Artificial Sequence
  Synthetic
ccgttttttttttttacaggtta

SEQ ID NO: 13482 - DNA, 23 bp, Artificial Sequence
  Synthetic
ccgttttttttttttacaagtta

SEQ ID NO: 13483 - DNA, 23 bp, Artificial Sequence
  Synthetic
ccgttttttttttttcattatta

SEQ ID NO: 13484 - DNA, 23 bp, Artificial Sequence
  Synthetic
ccgttttttttttttaaagagac

SEQ ID NO: 13485 - DNA, 23 bp, Artificial Sequence
  Synthetic
ccgttttttttttttgcaagccc

SEQ ID NO: 13486 - DNA, 23 bp, Artificial Sequence
  Synthetic
ccgttttttttttttgccctttt

SEQ ID NO: 13487 - DNA, 23 bp, Artificial Sequence
  Synthetic
ccgttttttttttttgaccatgg

SEQ ID NO: 13488 - DNA, 23 bp, Artificial Sequence
  Synthetic
ccgttttttttttttagctggtt

SEQ ID NO: 13489 - DNA, 23 bp, Artificial Sequence
  Synthetic
ccgttttttttttttacatagga

SEQ ID NO: 13490 - DNA, 23 bp, Artificial Sequence
  Synthetic
ccgttttttttttttagatagga

SEQ ID NO: 13491 - DNA, 23 bp, Artificial Sequence
  Synthetic
ccgttttttttttttcgcgtatt

SEQ ID NO: 13492 - DNA, 23 bp, Artificial Sequence
  Synthetic
ccgttttttttttttgcctgatt

SEQ ID NO: 13493 - DNA, 23 bp, Artificial Sequence
  Synthetic
ccgttttttttttttaccatagg

SEQ ID NO: 13494 - DNA, 23 bp, Artificial Sequence
  Synthetic
ccgttttttttttttgtagtgct

SEQ ID NO: 13495 - DNA, 23 bp, Artificial Sequence
  Synthetic
ccgttttttttttttgtagtgct

SEQ ID NO: 13496 - DNA, 23 bp, Artificial Sequence
  Synthetic
ccgttttttttttttgtacatca

SEQ ID NO: 13497 - DNA, 23 bp, Artificial Sequence
  Synthetic
ccgttttttttttttcaaagttc

SEQ ID NO: 13498 - DNA, 23 bp, Artificial Sequence
  Synthetic
ccgttttttttttttcaaagttc

SEQ ID NO: 13499 - DNA, 23 bp, Artificial Sequence
  Synthetic
ccgttttttttttttatcacttt

SEQ ID NO: 13500 - DNA, 23 bp, Artificial Sequence
  Synthetic
ccgttttttttttttctcatttt

SEQ ID NO: 13501 - DNA, 23 bp, Artificial Sequence
  Synthetic
ccgttttttttttttacaaacca

SEQ ID NO: 13502 - DNA, 23 bp, Artificial Sequence
  Synthetic
ccgttttttttttttcaaaccat

SEQ ID NO: 13503 - DNA, 23 bp, Artificial Sequence
  Synthetic
ccgttttttttttttccaatatt

SEQ ID NO: 13504 - DNA, 23 bp, Artificial Sequence
  Synthetic
ccgttttttttttttcctgcact

SEQ ID NO: 13505 - DNA, 23 bp, Artificial Sequence
  Synthetic
ccgttttttttttttctgcacta

SEQ ID NO: 13506 - DNA, 23 bp, Artificial Sequence
  Synthetic
ccgttttttttttttctcaccga

SEQ ID NO: 13507 - DNA, 23 bp, Artificial Sequence
  Synthetic
ccgttttttttttttgtacaatc

SEQ ID NO: 13508 - DNA, 23 bp, Artificial Sequence
  Synthetic
ccgttttttttttttccaccgac

SEQ ID NO: 13509 - DNA, 23 bp, Artificial Sequence
  Synthetic
ccgttttttttttttgttggcaa

SEQ ID NO: 13510 - DNA, 23 bp, Artificial Sequence
  Synthetic
ccgttttttttttttagtgaatt

SEQ ID NO: 13511 - DNA, 23 bp, Artificial Sequence
  Synthetic
ccgttttttttttttccttatca

SEQ ID NO: 13512 - DNA, 23 bp, Artificial Sequence
  Synthetic
ccgttttttttttttgctgcaac

SEQ ID NO: 13513 - DNA, 23 bp, Artificial Sequence
  Synthetic
ccgttttttttttttctgatacc

SEQ ID NO: 13514 - DNA, 23 bp, Artificial Sequence
  Synthetic
ccgttttttttttttcctaatat

SEQ ID NO: 13515 - DNA, 23 bp, Artificial Sequence
  Synthetic
ccgttttttttttttgctgtcaa

SEQ ID NO: 13516 - DNA, 23 bp, Artificial Sequence
  Synthetic
ccgttttttttttttctgggact

SEQ ID NO: 13517 - DNA, 23 bp, Artificial Sequence
  Synthetic
ccgttttttttttttcacatgga

SEQ ID NO: 13518 - DNA, 23 bp, Artificial Sequence
  Synthetic
ccgttttttttttttccaacaac

SEQ ID NO: 13519 - DNA, 23 bp, Artificial Sequence
  Synthetic
ccgttttttttttttccaacaac

SEQ ID NO: 13520 - DNA, 23 bp, Artificial Sequence
  Synthetic
ccgttttttttttttaacaggta

SEQ ID NO: 13521 - DNA, 23 bp, Artificial Sequence
  Synthetic
ccgttttttttttttagttttgc

SEQ ID NO: 13522 - DNA, 23 bp, Artificial Sequence
  Synthetic
ccgttttttttttttagttttgc

SEQ ID NO: 13523 - DNA, 23 bp, Artificial Sequence
  Synthetic
ccgttttttttttttacctgcac

SEQ ID NO: 13524 - DNA, 23 bp, Artificial Sequence
  Synthetic
ccgttttttttttttcatcgtta

SEQ ID NO: 13525 - DNA, 23 bp, Artificial Sequence
  Synthetic
ccgttttttttttttatcattac

SEQ ID NO: 13526 - DNA, 23 bp, Artificial Sequence
  Synthetic
ccgttttttttttttccatgccc

SEQ ID NO: 13527 - DNA, 23 bp, Artificial Sequence
  Synthetic
ccgttttttttttttaagtggtc

SEQ ID NO: 13528 - DNA, 23 bp, Artificial Sequence
  Synthetic
ccgttttttttttttggcatagg

SEQ ID NO: 13529 - DNA, 23 bp, Artificial Sequence
  Synthetic
ccgttttttttttttagactccg

SEQ ID NO: 13530 - DNA, 23 bp, Artificial Sequence
  Synthetic
ccgttttttttttttccaacacc

SEQ ID NO: 13531 - DNA, 23 bp, Artificial Sequence
  Synthetic
ccgttttttttttttgccgctgt

SEQ ID NO: 13532 - DNA, 23 bp, Artificial Sequence
  Synthetic
ccgttttttttttttgccatgac

SEQ ID NO: 13533 - DNA, 23 bp, Artificial Sequence
  Synthetic
ccgttttttttttttgcctgtct

SEQ ID NO: 13534 - DNA, 23 bp, Artificial Sequence
  Synthetic
ccgttttttttttttacagttgc

SEQ ID NO: 13535 - DNA, 23 bp, Artificial Sequence
  Synthetic
ccgttttttttttttacagttgc

SEQ ID NO: 13536 - DNA, 23 bp, Artificial Sequence
  Synthetic
ccgttttttttttttcaatcagt

SEQ ID NO: 13537 - DNA, 23 bp, Artificial Sequence
  Synthetic
ccgttttttttttttacatggtt

SEQ ID NO: 13538 - DNA, 23 bp, Artificial Sequence
  Synthetic
ccgttttttttttttcatggtta

SEQ ID NO: 13539 - DNA, 23 bp, Artificial Sequence
  Synthetic
ccgttttttttttttagaattgc

SEQ ID NO: 13540 - DNA, 23 bp, Artificial Sequence
  Synthetic
ccgttttttttttttaaacccag

SEQ ID NO: 13541 - DNA, 23 bp, Artificial Sequence
  Synthetic
ccgttttttttttttagacccag

SEQ ID NO: 13542 - DNA, 23 bp, Artificial Sequence
  Synthetic
ccgttttttttttttgggtattt

SEQ ID NO: 13543 - DNA, 23 bp, Artificial Sequence
  Synthetic
ccgttttttttttttcagttctt

SEQ ID NO: 13544 - DNA, 23 bp, Artificial Sequence
  Synthetic
ccgttttttttttttcagctctt

SEQ ID NO: 13545 - DNA, 23 bp, Artificial Sequence
  Synthetic
ccgttttttttttttgaaatccc

SEQ ID NO: 13546 - DNA, 23 bp, Artificial Sequence
  Synthetic
ccgttttttttttttgtaatccc

SEQ ID NO: 13547 - DNA, 23 bp, Artificial Sequence
  Synthetic
ccgttttttttttttgttcctgc

SEQ ID NO: 13548 - DNA, 23 bp, Artificial Sequence
  Synthetic
ccgttttttttttttagaccgag

SEQ ID NO: 13549 - DNA, 23 bp, Artificial Sequence
  Synthetic
ccgttttttttttttgcctatcc

SEQ ID NO: 13550 - DNA, 23 bp, Artificial Sequence
  Synthetic
ccgttttttttttttcagaactt

SEQ ID NO: 13551 - DNA, 23 bp, Artificial Sequence
  Synthetic
ccgttttttttttttcagaactt

SEQ ID NO: 13552 - DNA, 23 bp, Artificial Sequence
  Synthetic
ccgttttttttttttactgaact

SEQ ID NO: 13553 - DNA, 23 bp, Artificial Sequence
  Synthetic
ccgttttttttttttaccgattt

SEQ ID NO: 13554 - DNA, 23 bp, Artificial Sequence
  Synthetic
ccgttttttttttttcactgatt

SEQ ID NO: 13555 - DNA, 23 bp, Artificial Sequence
  Synthetic
ccgttttttttttttatgacaat

SEQ ID NO: 13556 - DNA, 23 bp, Artificial Sequence
  Synthetic
ccgttttttttttttgctgagtg

SEQ ID NO: 13557 - DNA, 23 bp, Artificial Sequence
  Synthetic
ccgttttttttttttcgagagtg

SEQ ID NO: 13558 - DNA, 23 bp, Artificial Sequence
  Synthetic
ccgttttttttttttccagtcgg

SEQ ID NO: 13559 - DNA, 23 bp, Artificial Sequence
  Synthetic
ccgttttttttttttaacaaaat

SEQ ID NO: 13560 - DNA, 23 bp, Artificial Sequence
  Synthetic
ccgttttttttttttaaggattt

SEQ ID NO: 13561 - DNA, 23 bp, Artificial Sequence
  Synthetic
ccgttttttttttttacgcgagc

SEQ ID NO: 13562 - DNA, 23 bp, Artificial Sequence
  Synthetic
ccgttttttttttttcggcatta

SEQ ID NO: 13563 - DNA, 23 bp, Artificial Sequence
  Synthetic
ccgttttttttttttgatgtagt

SEQ ID NO: 13564 - DNA, 23 bp, Artificial Sequence
  Synthetic
ccgttttttttttttcagtacca

SEQ ID NO: 13565 - DNA, 23 bp, Artificial Sequence
  Synthetic
ccgttttttttttttatccacat

SEQ ID NO: 13566 - DNA, 23 bp, Artificial Sequence
  Synthetic
ccgttttttttttttcagccgta

SEQ ID NO: 13567 - DNA, 23 bp, Artificial Sequence
  Synthetic
ccgttttttttttttacaaaatc

SEQ ID NO: 13568 - DNA, 23 bp, Artificial Sequence
  Synthetic
ccgttttttttttttatacagct

SEQ ID NO: 13569 - DNA, 23 bp, Artificial Sequence
  Synthetic
ccgttttttttttttcaggccgg

SEQ ID NO: 13570 - DNA, 23 bp, Artificial Sequence
  Synthetic
ccgttttttttttttgcaaaaat

SEQ ID NO: 13571 - DNA, 23 bp, Artificial Sequence
  Synthetic
ccgttttttttttttactataca

SEQ ID NO: 13572 - DNA, 23 bp, Artificial Sequence
  Synthetic
ccgttttttttttttaccacaca

SEQ ID NO: 13573 - DNA, 23 bp, Artificial Sequence
  Synthetic
ccgttttttttttttaccataca

SEQ ID NO: 13574 - DNA, 23 bp, Artificial Sequence
  Synthetic
ccgttttttttttttctatgcaa

SEQ ID NO: 13575 - DNA, 23 bp, Artificial Sequence
  Synthetic
ccgttttttttttttactataca

SEQ ID NO: 13576 - DNA, 23 bp, Artificial Sequence
  Synthetic
ccgttttttttttttctgtacaa

SEQ ID NO: 13577 - DNA, 23 bp, Artificial Sequence
  Synthetic
ccgttttttttttttcagcacaa

SEQ ID NO: 13578 - DNA, 23 bp, Artificial Sequence
  Synthetic
ccgttttttttttttactataca

SEQ ID NO: 13579 - DNA, 23 bp, Artificial Sequence
  Synthetic
ccgttttttttttttactattca

SEQ ID NO: 13580 - DNA, 23 bp, Artificial Sequence
  Synthetic
ccgttttttttttttacaagttc

SEQ ID NO: 13581 - DNA, 23 bp, Artificial Sequence
  Synthetic
ccgttttttttttttcagttatc

SEQ ID NO: 13582 - DNA, 23 bp, Artificial Sequence
  Synthetic
ccgttttttttttttatagccct

SEQ ID NO: 13583 - DNA, 23 bp, Artificial Sequence
  Synthetic
ccgttttttttttttcctgcact

SEQ ID NO: 13584 - DNA, 23 bp, Artificial Sequence
  Synthetic
ccgttttttttttttatagccct

SEQ ID NO: 13585 - DNA, 23 bp, Artificial Sequence
  Synthetic
ccgttttttttttttcaaattcg

SEQ ID NO: 13586 - DNA, 23 bp, Artificial Sequence
  Synthetic
ccgttttttttttttcaaacacc

SEQ ID NO: 13587 - DNA, 23 bp, Artificial Sequence
  Synthetic
ccgttttttttttttgcattcac

SEQ ID NO: 13588 - DNA, 23 bp, Artificial Sequence
  Synthetic
ccgttttttttttttgcattcac

SEQ ID NO: 13589 - DNA, 23 bp, Artificial Sequence
  Synthetic
ccgttttttttttttacaagtta

SEQ ID NO: 13590 - DNA, 23 bp, Artificial Sequence
  Synthetic
ccgttttttttttttcgcattat

SEQ ID NO: 13591 - DNA, 23 bp, Artificial Sequence
  Synthetic
ccgttttttttttttgcgtacca

SEQ ID NO: 13592 - DNA, 23 bp, Artificial Sequence
  Synthetic
ccgttttttttttttaagagacc

SEQ ID NO: 13593 - DNA, 23 bp, Artificial Sequence
  Synthetic
ccgttttttttttttgccctttt

SEQ ID NO: 13594 - DNA, 23 bp, Artificial Sequence
  Synthetic
ccgttttttttttttcgcccttt

SEQ ID NO: 13595 - DNA, 23 bp, Artificial Sequence
  Synthetic
ccgttttttttttttcagctggt

SEQ ID NO: 13596 - DNA, 23 bp, Artificial Sequence
  Synthetic
ccgttttttttttttgctggttg

SEQ ID NO: 13597 - DNA, 23 bp, Artificial Sequence
  Synthetic
ccgttttttttttttcagctggt

SEQ ID NO: 13598 - DNA, 23 bp, Artificial Sequence
  Synthetic
ccgttttttttttttacatagga

SEQ ID NO: 13599 - DNA, 23 bp, Artificial Sequence
  Synthetic
ccgttttttttttttacgcgtat

SEQ ID NO: 13600 - DNA, 23 bp, Artificial Sequence
  Synthetic
ccgttttttttttttattcacaa

SEQ ID NO: 13601 - DNA, 23 bp, Artificial Sequence
  Synthetic
ccgttttttttttttaccatagg

SEQ ID NO: 13602 - DNA, 23 bp, Artificial Sequence
  Synthetic
ccgttttttttttttccgtggtt

SEQ ID NO: 13603 - DNA, 23 bp, Artificial Sequence
  Synthetic
ccgttttttttttttcataaagt

SEQ ID NO: 13604 - DNA, 23 bp, Artificial Sequence
  Synthetic
ccgttttttttttttagtgcttt

SEQ ID NO: 13605 - DNA, 23 bp, Artificial Sequence
  Synthetic
ccgttttttttttttagtacatc

SEQ ID NO: 13606 - DNA, 23 bp, Artificial Sequence
  Synthetic
ccgttttttttttttacccatgg

SEQ ID NO: 13607 - DNA, 23 bp, Artificial Sequence
  Synthetic
ccgttttttttttttgcctatgg

SEQ ID NO: 13608 - DNA, 23 bp, Artificial Sequence
  Synthetic
ccgttttttttttttcagaactg

SEQ ID NO: 13609 - DNA, 23 bp, Artificial Sequence
  Synthetic
ccgttttttttttttcagaagca

SEQ ID NO: 13610 - DNA, 23 bp, Artificial Sequence
  Synthetic
ccgttttttttttttcaaagttc

SEQ ID NO: 13611 - DNA, 23 bp, Artificial Sequence
  Synthetic
ccgttttttttttttacttttgt

SEQ ID NO: 13612 - DNA, 23 bp, Artificial Sequence
  Synthetic
ccgttttttttttttccctatca

SEQ ID NO: 13613 - DNA, 23 bp, Artificial Sequence
  Synthetic
ccgttttttttttttcaaaccat

SEQ ID NO: 13614 - DNA, 23 bp, Artificial Sequence
  Synthetic
ccgttttttttttttcaaaccat

SEQ ID NO: 13615 - DNA, 23 bp, Artificial Sequence
  Synthetic
ccgttttttttttttaccaatat

SEQ ID NO: 13616 - DNA, 23 bp, Artificial Sequence
  Synthetic
ccgttttttttttttcaagtgcc

SEQ ID NO: 13617 - DNA, 23 bp, Artificial Sequence
  Synthetic
ccgttttttttttttctacctgc

SEQ ID NO: 13618 - DNA, 23 bp, Artificial Sequence
  Synthetic
ccgttttttttttttctcaccga

SEQ ID NO: 13619 - DNA, 23 bp, Artificial Sequence
  Synthetic
ccgttttttttttttgtacaatc

SEQ ID NO: 13620 - DNA, 23 bp, Artificial Sequence
  Synthetic
ccgttttttttttttccaccgac

SEQ ID NO: 13621 - DNA, 23 bp, Artificial Sequence
  Synthetic
ccgttttttttttttagtgaatt

SEQ ID NO: 13622 - DNA, 23 bp, Artificial Sequence
  Synthetic
ccgttttttttttttcccttatc

SEQ ID NO: 13623 - DNA, 23 bp, Artificial Sequence
  Synthetic
ccgttttttttttttgctgcaac

SEQ ID NO: 13624 - DNA, 23 bp, Artificial Sequence
  Synthetic
ccgttttttttttttctgcacta

SEQ ID NO: 13625 - DNA, 23 bp, Artificial Sequence
  Synthetic
ccgttttttttttttactgcact

SEQ ID NO: 13626 - DNA, 23 bp, Artificial Sequence
  Synthetic
ccgttttttttttttcctaatat

SEQ ID NO: 13627 - DNA, 23 bp, Artificial Sequence
  Synthetic
ccgttttttttttttaagcggga

SEQ ID NO: 13628 - DNA, 23 bp, Artificial Sequence
  Synthetic
ccgttttttttttttcacatgga

SEQ ID NO: 13629 - DNA, 23 bp, Artificial Sequence
  Synthetic
ccgttttttttttttcaacaaca

SEQ ID NO: 13630 - DNA, 23 bp, Artificial Sequence
  Synthetic
ccgttttttttttttaacaggta

SEQ ID NO: 13631 - DNA, 23 bp, Artificial Sequence
  Synthetic
ccgttttttttttttcaatgtgc

SEQ ID NO: 13632 - DNA, 23 bp, Artificial Sequence
  Synthetic
ccgttttttttttttagttttgc

SEQ ID NO: 13633 - DNA, 23 bp, Artificial Sequence
  Synthetic
ccgttttttttttttagttttgc

SEQ ID NO: 13634 - DNA, 23 bp, Artificial Sequence
  Synthetic
ccgttttttttttttcatacttc

SEQ ID NO: 13635 - DNA, 23 bp, Artificial Sequence
  Synthetic
ccgttttttttttttcatacttc

SEQ ID NO: 13636 - DNA, 23 bp, Artificial Sequence
  Synthetic
ccgttttttttttttcatcgtta

SEQ ID NO: 13637 - DNA, 23 bp, Artificial Sequence
  Synthetic
ccgttttttttttttcatcatta

SEQ ID NO: 13638 - DNA, 23 bp, Artificial Sequence
  Synthetic
ccgttttttttttttccatgctc

SEQ ID NO: 13639 - DNA, 23 bp, Artificial Sequence
  Synthetic
ccgttttttttttttaagaagta

SEQ ID NO: 13640 - DNA, 23 bp, Artificial Sequence
  Synthetic
ccgttttttttttttaagtggtc

SEQ ID NO: 13641 - DNA, 23 bp, Artificial Sequence
  Synthetic
ccgttttttttttttggcatagg

SEQ ID NO: 13642 - DNA, 23 bp, Artificial Sequence
  Synthetic
ccgttttttttttttagactccg

SEQ ID NO: 13643 - DNA, 23 bp, Artificial Sequence
  Synthetic
ccgttttttttttttagattccg

SEQ ID NO: 13644 - DNA, 23 bp, Artificial Sequence
  Synthetic
ccgttttttttttttcacacact

SEQ ID NO: 13645 - DNA, 23 bp, Artificial Sequence
  Synthetic
ccgttttttttttttacctgcac

SEQ ID NO: 13646 - DNA, 23 bp, Artificial Sequence
  Synthetic
ccgttttttttttttacctgcac

SEQ ID NO: 13647 - DNA, 23 bp, Artificial Sequence
  Synthetic
ccgttttttttttttaacatcag

SEQ ID NO: 13648 - DNA, 23 bp, Artificial Sequence
  Synthetic
ccgttttttttttttggcatagg

SEQ ID NO: 13649 - DNA, 23 bp, Artificial Sequence
  Synthetic
ccgttttttttttttctgtcaat

SEQ ID NO: 13650 - DNA, 23 bp, Artificial Sequence
  Synthetic
ccgttttttttttttacagttgc

SEQ ID NO: 13651 - DNA, 23 bp, Artificial Sequence
  Synthetic
ccgttttttttttttccaatcag

SEQ ID NO: 13652 - DNA, 23 bp, Artificial Sequence
  Synthetic
ccgttttttttttttcatggtta

SEQ ID NO: 13653 - DNA, 23 bp, Artificial Sequence
  Synthetic
ccgttttttttttttgaattgcg

SEQ ID NO: 13654 - DNA, 23 bp, Artificial Sequence
  Synthetic
ccgttttttttttttaaacccag

SEQ ID NO: 13655 - DNA, 23 bp, Artificial Sequence
  Synthetic
ccgttttttttttttagacccag

SEQ ID NO: 13656 - DNA, 23 bp, Artificial Sequence
  Synthetic
ccgttttttttttttagacccag

SEQ ID NO: 13657 - DNA, 23 bp, Artificial Sequence
  Synthetic
ccgttttttttttttgggtattt

SEQ ID NO: 13658 - DNA, 23 bp, Artificial Sequence
  Synthetic
ccgttttttttttttgtaatccc

SEQ ID NO: 13659 - DNA, 23 bp, Artificial Sequence
  Synthetic
ccgttttttttttttgttcctgc

SEQ ID NO: 13660 - DNA, 23 bp, Artificial Sequence
  Synthetic
ccgttttttttttttcctatcct

SEQ ID NO: 13661 - DNA, 23 bp, Artificial Sequence
  Synthetic
ccgttttttttttttcagaactt

SEQ ID NO: 13662 - DNA, 23 bp, Artificial Sequence
  Synthetic
ccgttttttttttttaccgattt

SEQ ID NO: 13663 - DNA, 23 bp, Artificial Sequence
  Synthetic
ccgttttttttttttacactgat

SEQ ID NO: 13664 - DNA, 23 bp, Artificial Sequence
  Synthetic
ccgttttttttttttccgatttc

SEQ ID NO: 13665 - DNA, 23 bp, Artificial Sequence
  Synthetic
ccgttttttttttttgctttgac

SEQ ID NO: 13666 - DNA, 23 bp, Artificial Sequence
  Synthetic
ccgttttttttttttactaaaac

SEQ ID NO: 13667 - DNA, 23 bp, Artificial Sequence
  Synthetic
ccgttttttttttttactaaaac

SEQ ID NO: 13668 - DNA, 23 bp, Artificial Sequence
  Synthetic
ccgttttttttttttgaaagcac

SEQ ID NO: 13669 - DNA, 23 bp, Artificial Sequence
  Synthetic
ccgttttttttttttcactgaaa

SEQ ID NO: 13670 - DNA, 23 bp, Artificial Sequence
  Synthetic
ccgttttttttttttagcaggta

SEQ ID NO: 13671 - DNA, 23 bp, Artificial Sequence
  Synthetic
ccgttttttttttttaactaaaa

SEQ ID NO: 13672 - DNA, 23 bp, Artificial Sequence
  Synthetic
ccgttttttttttttctgcaaac

SEQ ID NO: 13673 - DNA, 23 bp, Artificial Sequence
  Synthetic
ccgttttttttttttccagtcga

SEQ ID NO: 13674 - DNA, 23 bp, Artificial Sequence
  Synthetic
ccgttttttttttttgctgagtg

SEQ ID NO: 13675 - DNA, 23 bp, Artificial Sequence
  Synthetic
ccgttttttttttttgctgagag

SEQ ID NO: 13676 - DNA, 23 bp, Artificial Sequence
  Synthetic
ccgttttttttttttccagtcgg

SEQ ID NO: 13677 - DNA, 23 bp, Artificial Sequence
  Synthetic
ccgttttttttttttcagtcaag

SEQ ID NO: 13678 - DNA, 23 bp, Artificial Sequence
  Synthetic
ccgttttttttttttagctatgc

SEQ ID NO: 13679 - DNA, 23 bp, Artificial Sequence
  Synthetic
ccgttttttttttttcaacttag

SEQ ID NO: 13680 - DNA, 23 bp, Artificial Sequence
  Synthetic
ccgttttttttttttaatgcaac

SEQ ID NO: 13681 - DNA, 23 bp, Artificial Sequence
  Synthetic
ccgttttttttttttacaaccag

SEQ ID NO: 13682 - DNA, 23 bp, Artificial Sequence
  Synthetic
ccgttttttttttttaatcagct

SEQ ID NO: 13683 - DNA, 23 bp, Artificial Sequence
  Synthetic
ccgttttttttttttcaatcagc

SEQ ID NO: 13684 - DNA, 23 bp, Artificial Sequence
  Synthetic
ccgttttttttttttaaggattt

SEQ ID NO: 13685 - DNA, 23 bp, Artificial Sequence
  Synthetic
ccgttttttttttttaccattgc

SEQ ID NO: 13686 - DNA, 23 bp, Artificial Sequence
  Synthetic
ccgttttttttttttacgcgagc

SEQ ID NO: 13687 - DNA, 23 bp, Artificial Sequence
  Synthetic
ccgttttttttttttgccacaat

SEQ ID NO: 13688 - DNA, 23 bp, Artificial Sequence
  Synthetic
ccgttttttttttttcggcatta

SEQ ID NO: 13689 - DNA, 23 bp, Artificial Sequence
  Synthetic
ccgttttttttttttccagctaa

SEQ ID NO: 13690 - DNA, 23 bp, Artificial Sequence
  Synthetic
ccgttttttttttttaactcagt

SEQ ID NO: 13691 - DNA, 23 bp, Artificial Sequence
  Synthetic
ccgttttttttttttgatgtagt

SEQ ID NO: 13692 - DNA, 23 bp, Artificial Sequence
  Synthetic
ccgttttttttttttacaaccat

SEQ ID NO: 13693 - DNA, 23 bp, Artificial Sequence
  Synthetic
ccgttttttttttttacacagtg

SEQ ID NO: 13694 - DNA, 23 bp, Artificial Sequence
  Synthetic
ccgttttttttttttcttatgtg

SEQ ID NO: 13695 - DNA, 23 bp, Artificial Sequence
  Synthetic
ccgttttttttttttcagccgta

SEQ ID NO: 13696 - DNA, 23 bp, Artificial Sequence
  Synthetic
ccgttttttttttttagcatgga

SEQ ID NO: 13697 - DNA, 23 bp, Artificial Sequence
  Synthetic
ccgttttttttttttaaacatca

SEQ ID NO: 13698 - DNA, 23 bp, Artificial Sequence
  Synthetic
ccgttttttttttttaacaaaat

SEQ ID NO: 13699 - DNA, 23 bp, Artificial Sequence
  Synthetic
ccgttttttttttttaatcccat

SEQ ID NO: 13700 - DNA, 23 bp, Artificial Sequence
  Synthetic
ccgttttttttttttacaaaaat

SEQ ID NO: 13701 - DNA, 23 bp, Artificial Sequence
  Synthetic
ccgttttttttttttatacagct

SEQ ID NO: 13702 - DNA, 23 bp, Artificial Sequence
  Synthetic
ccgttttttttttttcattcggt

SEQ ID NO: 13703 - DNA, 23 bp, Artificial Sequence
  Synthetic
ccgttttttttttttaggccggg

SEQ ID NO: 13704 - DNA, 23 bp, Artificial Sequence
  Synthetic
ccgttttttttttttacaagatc

SEQ ID NO: 13705 - DNA, 23 bp, Artificial Sequence
  Synthetic
ccgttttttttttttacaagttc

SEQ ID NO: 13706 - DNA, 23 bp, Artificial Sequence
  Synthetic
ccgttttttttttttcagttatc

SEQ ID NO: 13707 - DNA, 23 bp, Artificial Sequence
  Synthetic
ccgttttttttttttatagccct

SEQ ID NO: 13708 - DNA, 23 bp, Artificial Sequence
  Synthetic
ccgttttttttttttcaggagtc

SEQ ID NO: 13709 - DNA, 23 bp, Artificial Sequence
  Synthetic
ccgttttttttttttctacctgc

SEQ ID NO: 13710 - DNA, 23 bp, Artificial Sequence
  Synthetic
ccgttttttttttttctgcactg

SEQ ID NO: 13711 - DNA, 23 bp, Artificial Sequence
  Synthetic
ccgttttttttttttatagccct

SEQ ID NO: 13712 - DNA, 23 bp, Artificial Sequence
  Synthetic
ccgttttttttttttacaaattc

SEQ ID NO: 13713 - DNA, 23 bp, Artificial Sequence
  Synthetic
ccgttttttttttttcaaattcg

SEQ ID NO: 13714 - DNA, 23 bp, Artificial Sequence
  Synthetic
ccgttttttttttttgcattcac

SEQ ID NO: 13715 - DNA, 23 bp, Artificial Sequence
  Synthetic
ccgttttttttttttacaagtta

SEQ ID NO: 13716 - DNA, 23 bp, Artificial Sequence
  Synthetic
ccgttttttttttttccctttta

SEQ ID NO: 13717 - DNA, 23 bp, Artificial Sequence
  Synthetic
ccgttttttttttttcagctggt

SEQ ID NO: 13718 - DNA, 23 bp, Artificial Sequence
  Synthetic
ccgttttttttttttcctctggt

SEQ ID NO: 13719 - DNA, 23 bp, Artificial Sequence
  Synthetic
ccgttttttttttttacatagga

SEQ ID NO: 13720 - DNA, 23 bp, Artificial Sequence
  Synthetic
ccgttttttttttttcatcatca

SEQ ID NO: 13721 - DNA, 23 bp, Artificial Sequence
  Synthetic
ccgttttttttttttcatcttta

SEQ ID NO: 13722 - DNA, 23 bp, Artificial Sequence
  Synthetic
ccgttttttttttttagctacag

SEQ ID NO: 13723 - DNA, 23 bp, Artificial Sequence
  Synthetic
ccgttttttttttttagggattc

SEQ ID NO: 13724 - DNA, 23 bp, Artificial Sequence
  Synthetic
ccgttttttttttttacttttgt

SEQ ID NO: 13725 - DNA, 23 bp, Artificial Sequence
  Synthetic
ccgttttttttttttgaaggcaa

SEQ ID NO: 13726 - DNA, 23 bp, Artificial Sequence
  Synthetic
ccgttttttttttttacaaacca

SEQ ID NO: 13727 - DNA, 23 bp, Artificial Sequence
  Synthetic
ccgttttttttttttaaaccatg

SEQ ID NO: 13728 - DNA, 23 bp, Artificial Sequence
  Synthetic
ccgttttttttttttgccaatat

SEQ ID NO: 13729 - DNA, 23 bp, Artificial Sequence
  Synthetic
ccgttttttttttttcaagtgcc

SEQ ID NO: 13730 - DNA, 23 bp, Artificial Sequence
  Synthetic
ccgttttttttttttctacctgc

SEQ ID NO: 13731 - DNA, 23 bp, Artificial Sequence
  Synthetic
ccgttttttttttttctgcacta

SEQ ID NO: 13732 - DNA, 23 bp, Artificial Sequence
  Synthetic
ccgttttttttttttctcaccga

SEQ ID NO: 13733 - DNA, 23 bp, Artificial Sequence
  Synthetic
ccgttttttttttttgtacaatc

SEQ ID NO: 13734 - DNA, 23 bp, Artificial Sequence
  Synthetic
ccgttttttttttttacccaccg

SEQ ID NO: 13735 - DNA, 23 bp, Artificial Sequence
  Synthetic
ccgttttttttttttctcaccga

SEQ ID NO: 13736 - DNA, 23 bp, Artificial Sequence
  Synthetic
ccgttttttttttttagtgaatt

SEQ ID NO: 13737 - DNA, 23 bp, Artificial Sequence
  Synthetic
ccgttttttttttttagcccaaa

SEQ ID NO: 13738 - DNA, 23 bp, Artificial Sequence
  Synthetic
ccgttttttttttttggctgcaa

SEQ ID NO: 13739 - DNA, 23 bp, Artificial Sequence
  Synthetic
ccgttttttttttttcctaatat

SEQ ID NO: 13740 - DNA, 23 bp, Artificial Sequence
  Synthetic
ccgttttttttttttcacatgga

SEQ ID NO: 13741 - DNA, 23 bp, Artificial Sequence
  Synthetic
ccgttttttttttttccaatatt

SEQ ID NO: 13742 - DNA, 23 bp, Artificial Sequence
  Synthetic
ccgttttttttttttcaacaaca

SEQ ID NO: 13743 - DNA, 23 bp, Artificial Sequence
  Synthetic
ccgttttttttttttctatctcc

SEQ ID NO: 13744 - DNA, 23 bp, Artificial Sequence
  Synthetic
ccgttttttttttttaacaggta

SEQ ID NO: 13745 - DNA, 23 bp, Artificial Sequence
  Synthetic
ccgttttttttttttagttttgc

SEQ ID NO: 13746 - DNA, 23 bp, Artificial Sequence
  Synthetic
ccgttttttttttttagttttgc

SEQ ID NO: 13747 - DNA, 23 bp, Artificial Sequence
  Synthetic
ccgttttttttttttcctgcact

SEQ ID NO: 13748 - DNA, 23 bp, Artificial Sequence
  Synthetic
ccgttttttttttttcatcatta

SEQ ID NO: 13749 - DNA, 23 bp, Artificial Sequence
  Synthetic
ccgttttttttttttggcatagg

SEQ ID NO: 13750 - DNA, 23 bp, Artificial Sequence
  Synthetic
ccgttttttttttttagactccg

SEQ ID NO: 13751 - DNA, 23 bp, Artificial Sequence
  Synthetic
ccgttttttttttttaacatcag

SEQ ID NO: 13752 - DNA, 23 bp, Artificial Sequence
  Synthetic
ccgttttttttttttgcctgtct

SEQ ID NO: 13753 - DNA, 23 bp, Artificial Sequence
  Synthetic
ccgttttttttttttctgtcaat

SEQ ID NO: 13754 - DNA, 23 bp, Artificial Sequence
  Synthetic
ccgttttttttttttacagttgc

SEQ ID NO: 13755 - DNA, 23 bp, Artificial Sequence
  Synthetic
ccgttttttttttttccaatcag

SEQ ID NO: 13756 - DNA, 23 bp, Artificial Sequence
  Synthetic
ccgttttttttttttcatggtta

SEQ ID NO: 13757 - DNA, 23 bp, Artificial Sequence
  Synthetic
ccgttttttttttttgaattgcg

SEQ ID NO: 13758 - DNA, 23 bp, Artificial Sequence
  Synthetic
ccgttttttttttttaagtgtca

SEQ ID NO: 13759 - DNA, 23 bp, Artificial Sequence
  Synthetic
ccgttttttttttttaaacccag

SEQ ID NO: 13760 - DNA, 23 bp, Artificial Sequence
  Synthetic
ccgttttttttttttgggtattt

SEQ ID NO: 13761 - DNA, 23 bp, Artificial Sequence
  Synthetic
ccgttttttttttttaacggaac

SEQ ID NO: 13762 - DNA, 23 bp, Artificial Sequence
  Synthetic
ccgttttttttttttgaaatccc

SEQ ID NO: 13763 - DNA, 23 bp, Artificial Sequence
  Synthetic
ccgttttttttttttgttcctgc

SEQ ID NO: 13764 - DNA, 23 bp, Artificial Sequence
  Synthetic
ccgttttttttttttagaccgag

SEQ ID NO: 13765 - DNA, 23 bp, Artificial Sequence
  Synthetic
ccgttttttttttttgcctatcc

SEQ ID NO: 13766 - DNA, 23 bp, Artificial Sequence
  Synthetic
ccgttttttttttttgcggaact

SEQ ID NO: 13767 - DNA, 23 bp, Artificial Sequence
  Synthetic
ccgttttttttttttcaatagac

SEQ ID NO: 13768 - DNA, 23 bp, Artificial Sequence
  Synthetic
ccgttttttttttttaccgattt

SEQ ID NO: 13769 - DNA, 23 bp, Artificial Sequence
  Synthetic
ccgttttttttttttctgatttc

SEQ ID NO: 13770 - DNA, 23 bp, Artificial Sequence
  Synthetic
ccgttttttttttttctgcaaac

SEQ ID NO: 13771 - DNA, 23 bp, Artificial Sequence
  Synthetic
ccgttttttttttttccagtcga

SEQ ID NO: 13772 - DNA, 23 bp, Artificial Sequence
  Synthetic
ccgttttttttttttctgagtgt

SEQ ID NO: 13773 - DNA, 23 bp, Artificial Sequence
  Synthetic
ccgttttttttttttccagtcgg

SEQ ID NO: 13774 - DNA, 23 bp, Artificial Sequence
  Synthetic
ccgttttttttttttagctatgc

SEQ ID NO: 13775 - DNA, 23 bp, Artificial Sequence
  Synthetic
ccgttttttttttttcaacttag

SEQ ID NO: 13776 - DNA, 23 bp, Artificial Sequence
  Synthetic
ccgttttttttttttaatgcaac

SEQ ID NO: 13777 - DNA, 23 bp, Artificial Sequence
  Synthetic
ccgttttttttttttcaaccagc

SEQ ID NO: 13778 - DNA, 23 bp, Artificial Sequence
  Synthetic
ccgttttttttttttacaaaatc

SEQ ID NO: 13779 - DNA, 23 bp, Artificial Sequence
  Synthetic
ccgttttttttttttatacagct

SEQ ID NO: 13780 - DNA, 23 bp, Artificial Sequence
  Synthetic
ccgttttttttttttcaggccgg

SEQ ID NO: 13781 - DNA, 23 bp, Artificial Sequence
  Synthetic
ccgttttttttttttacctgcac

SEQ ID NO: 13782 - DNA, 23 bp, Artificial Sequence
  Synthetic
ccgttttttttttttctcaataa

SEQ ID NO: 13783 - DNA, 23 bp, Artificial Sequence
  Synthetic
ccgttttttttttttcaaaaatg

SEQ ID NO: 13784 - DNA, 23 bp, Artificial Sequence
  Synthetic
ccgttttttttttttacaataca

SEQ ID NO: 13785 - DNA, 23 bp, Artificial Sequence
  Synthetic
ccgttttttttttttacaagatc

SEQ ID NO: 13786 - DNA, 23 bp, Artificial Sequence
  Synthetic
ccgttttttttttttgctcactc

SEQ ID NO: 13787 - DNA, 23 bp, Artificial Sequence
  Synthetic
ccgttttttttttttgctctctc

SEQ ID NO: 13788 - DNA, 23 bp, Artificial Sequence
  Synthetic
ccgttttttttttttgctctcta

SEQ ID NO: 13789 - DNA, 23 bp, Artificial Sequence
  Synthetic
ccgttttttttttttgctctcta

SEQ ID NO: 13790 - DNA, 23 bp, Artificial Sequence
  Synthetic
ccgttttttttttttgctctcta

SEQ ID NO: 13791 - DNA, 23 bp, Artificial Sequence
  Synthetic
ccgttttttttttttgagctccc

SEQ ID NO: 13792 - DNA, 23 bp, Artificial Sequence
  Synthetic
ccgttttttttttttgcatacag

SEQ ID NO: 13793 - DNA, 23 bp, Artificial Sequence
  Synthetic
ccgttttttttttttgggaatga

SEQ ID NO: 13794 - DNA, 23 bp, Artificial Sequence
  Synthetic
ccgttttttttttttgggaatga

SEQ ID NO: 13795 - DNA, 23 bp, Artificial Sequence
  Synthetic
ccgttttttttttttgatcatgc

SEQ ID NO: 13796 - DNA, 23 bp, Artificial Sequence
  Synthetic
ccgttttttttttttgatcatgc

SEQ ID NO: 13797 - DNA, 23 bp, Artificial Sequence
  Synthetic
ccgttttttttttttccgacctg

SEQ ID NO: 13798 - DNA, 23 bp, Artificial Sequence
  Synthetic
ccgttttttttttttcggcaagt

SEQ ID NO: 13799 - DNA, 23 bp, Artificial Sequence
  Synthetic
ccgttttttttttttgcagcatc

SEQ ID NO: 13800 - DNA, 23 bp, Artificial Sequence
  Synthetic
ccgttttttttttttgcagcatc

SEQ ID NO: 13801 - DNA, 23 bp, Artificial Sequence
  Synthetic
ccgttttttttttttggagctcc

SEQ ID NO: 13802 - DNA, 23 bp, Artificial Sequence
  Synthetic
ccgttttttttttttggagctcc

SEQ ID NO: 13803 - DNA, 23 bp, Artificial Sequence
  Synthetic
ccgttttttttttttggagctcc

SEQ ID NO: 13804 - DNA, 23 bp, Artificial Sequence
  Synthetic
ccgttttttttttttagttcaag

SEQ ID NO: 13805 - DNA, 23 bp, Artificial Sequence
  Synthetic
ccgttttttttttttagttcaag

SEQ ID NO: 13806 - DNA, 23 bp, Artificial Sequence
  Synthetic
ccgttttttttttttaggggtga

SEQ ID NO: 13807 - DNA, 23 bp, Artificial Sequence
  Synthetic
ccgttttttttttttaggggtga

SEQ ID NO: 13808 - DNA, 23 bp, Artificial Sequence
  Synthetic
ccgttttttttttttgcctggat

SEQ ID NO: 13809 - DNA, 23 bp, Artificial Sequence
  Synthetic
ccgttttttttttttggtgaaga

SEQ ID NO: 13810 - DNA, 23 bp, Artificial Sequence
  Synthetic
ccgttttttttttttcacgggaa

SEQ ID NO: 13811 - DNA, 23 bp, Artificial Sequence
  Synthetic
ccgttttttttttttacaaacta

SEQ ID NO: 13812 - DNA, 23 bp, Artificial Sequence
  Synthetic
ccgttttttttttttccaggtgt

SEQ ID NO: 13813 - DNA, 23 bp, Artificial Sequence
  Synthetic
ccgttttttttttttcgcgcgcc

SEQ ID NO: 13814 - DNA, 23 bp, Artificial Sequence
  Synthetic
ccgttttttttttttggacgagg

SEQ ID NO: 13815 - DNA, 23 bp, Artificial Sequence
  Synthetic
ccgttttttttttttgtccgagc

SEQ ID NO: 13816 - DNA, 23 bp, Artificial Sequence
  Synthetic
ccgttttttttttttcgcgggag

SEQ ID NO: 13817 - DNA, 23 bp, Artificial Sequence
  Synthetic
ccgttttttttttttatccacct

SEQ ID NO: 13818 - DNA, 23 bp, Artificial Sequence
  Synthetic
ccgttttttttttttgcccacgg

SEQ ID NO: 13819 - DNA, 23 bp, Artificial Sequence
  Synthetic
ccgttttttttttttccccctgc

SEQ ID NO: 13820 - DNA, 23 bp, Artificial Sequence
  Synthetic
ccgttttttttttttcgctctcg

SEQ ID NO: 13821 - DNA, 23 bp, Artificial Sequence
  Synthetic
ccgttttttttttttacatcgtc

SEQ ID NO: 13822 - DNA, 23 bp, Artificial Sequence
  Synthetic
ccgttttttttttttactataca

SEQ ID NO: 13823 - DNA, 23 bp, Artificial Sequence
  Synthetic
ccgttttttttttttaccacaca

SEQ ID NO: 13824 - DNA, 23 bp, Artificial Sequence
  Synthetic
ccgttttttttttttaccataca

SEQ ID NO: 13825 - DNA, 23 bp, Artificial Sequence
  Synthetic
ccgttttttttttttctatgcaa

SEQ ID NO: 13826 - DNA, 23 bp, Artificial Sequence
  Synthetic
ccgttttttttttttctatacaa

SEQ ID NO: 13827 - DNA, 23 bp, Artificial Sequence
  Synthetic
ccgttttttttttttactataca

SEQ ID NO: 13828 - DNA, 23 bp, Artificial Sequence
  Synthetic
ccgttttttttttttctgtacaa

SEQ ID NO: 13829 - DNA, 23 bp, Artificial Sequence
  Synthetic
ccgttttttttttttcagcacaa

SEQ ID NO: 13830 - DNA, 23 bp, Artificial Sequence
  Synthetic
ccgttttttttttttcatacttc

SEQ ID NO: 13831 - DNA, 23 bp, Artificial Sequence
  Synthetic
ccgttttttttttttacaagttc

SEQ ID NO: 13832 - DNA, 23 bp, Artificial Sequence
  Synthetic
ccgttttttttttttcagttatc

SEQ ID NO: 13833 - DNA, 23 bp, Artificial Sequence
  Synthetic
ccgttttttttttttatagccct

SEQ ID NO: 13834 - DNA, 23 bp, Artificial Sequence
  Synthetic
ccgttttttttttttcaggagtc

SEQ ID NO: 13835 - DNA, 23 bp, Artificial Sequence
  Synthetic
ccgttttttttttttctacctgc

SEQ ID NO: 13836 - DNA, 23 bp, Artificial Sequence
  Synthetic
ccgttttttttttttctgcactg

SEQ ID NO: 13837 - DNA, 23 bp, Artificial Sequence
  Synthetic
ccgttttttttttttatagccct

SEQ ID NO: 13838 - DNA, 23 bp, Artificial Sequence
  Synthetic
ccgttttttttttttacaaattc

SEQ ID NO: 13839 - DNA, 23 bp, Artificial Sequence
  Synthetic
ccgttttttttttttcaaattcg

SEQ ID NO: 13840 - DNA, 23 bp, Artificial Sequence
  Synthetic
ccgttttttttttttcaaacacc

SEQ ID NO: 13841 - DNA, 23 bp, Artificial Sequence
  Synthetic
ccgttttttttttttgcattcac

SEQ ID NO: 13842 - DNA, 23 bp, Artificial Sequence
  Synthetic
ccgttttttttttttacaggtta

SEQ ID NO: 13843 - DNA, 23 bp, Artificial Sequence
  Synthetic
ccgttttttttttttacaagtta

SEQ ID NO: 13844 - DNA, 23 bp, Artificial Sequence
  Synthetic
ccgttttttttttttcattatta

SEQ ID NO: 13845 - DNA, 23 bp, Artificial Sequence
  Synthetic
ccgttttttttttttgcgtacca

SEQ ID NO: 13846 - DNA, 23 bp, Artificial Sequence
  Synthetic
ccgttttttttttttgccaagct

SEQ ID NO: 13847 - DNA, 23 bp, Artificial Sequence
  Synthetic
ccgttttttttttttaaagagac

SEQ ID NO: 13848 - DNA, 23 bp, Artificial Sequence
  Synthetic
ccgttttttttttttaaagagac

SEQ ID NO: 13849 - DNA, 23 bp, Artificial Sequence
  Synthetic
ccgttttttttttttcaagccca

SEQ ID NO: 13850 - DNA, 23 bp, Artificial Sequence
  Synthetic
ccgttttttttttttgccctttt

SEQ ID NO: 13851 - DNA, 23 bp, Artificial Sequence
  Synthetic
ccgttttttttttttgccctttc

SEQ ID NO: 13852 - DNA, 23 bp, Artificial Sequence
  Synthetic
ccgttttttttttttgaccatgg

SEQ ID NO: 13853 - DNA, 23 bp, Artificial Sequence
  Synthetic
ccgttttttttttttcagctggt

SEQ ID NO: 13854 - DNA, 23 bp, Artificial Sequence
  Synthetic
ccgttttttttttttgctggttg

SEQ ID NO: 13855 - DNA, 23 bp, Artificial Sequence
  Synthetic
ccgttttttttttttcctctggt

SEQ ID NO: 13856 - DNA, 23 bp, Artificial Sequence
  Synthetic
ccgttttttttttttacatagga

SEQ ID NO: 13857 - DNA, 23 bp, Artificial Sequence
  Synthetic
ccgttttttttttttacatagga

SEQ ID NO: 13858 - DNA, 23 bp, Artificial Sequence
  Synthetic
ccgttttttttttttcatcatca

SEQ ID NO: 13859 - DNA, 23 bp, Artificial Sequence
  Synthetic
ccgttttttttttttacgcgtat

SEQ ID NO: 13860 - DNA, 23 bp, Artificial Sequence
  Synthetic
ccgttttttttttttattcacaa

SEQ ID NO: 13861 - DNA, 23 bp, Artificial Sequence
  Synthetic
ccgttttttttttttgacacgtg

SEQ ID NO: 13862 - DNA, 23 bp, Artificial Sequence
  Synthetic
ccgttttttttttttaccatagg

SEQ ID NO: 13863 - DNA, 23 bp, Artificial Sequence
  Synthetic
ccgttttttttttttcatcttta

SEQ ID NO: 13864 - DNA, 23 bp, Artificial Sequence
  Synthetic
ccgttttttttttttcataaagt

SEQ ID NO: 13865 - DNA, 23 bp, Artificial Sequence
  Synthetic
ccgttttttttttttagtgcttt

SEQ ID NO: 13866 - DNA, 23 bp, Artificial Sequence
  Synthetic
ccgttttttttttttagctacag

SEQ ID NO: 13867 - DNA, 23 bp, Artificial Sequence
  Synthetic
ccgttttttttttttagtacatc

SEQ ID NO: 13868 - DNA, 23 bp, Artificial Sequence
  Synthetic
ccgttttttttttttagggattc

SEQ ID NO: 13869 - DNA, 23 bp, Artificial Sequence
  Synthetic
ccgttttttttttttacccatgg

SEQ ID NO: 13870 - DNA, 23 bp, Artificial Sequence
  Synthetic
ccgttttttttttttgcctatgg

SEQ ID NO: 13871 - DNA, 23 bp, Artificial Sequence
  Synthetic
ccgttttttttttttcagaagca

SEQ ID NO: 13872 - DNA, 23 bp, Artificial Sequence
  Synthetic
ccgttttttttttttcaaagttc

SEQ ID NO: 13873 - DNA, 23 bp, Artificial Sequence
  Synthetic
ccgttttttttttttcaaagttc

SEQ ID NO: 13874 - DNA, 23 bp, Artificial Sequence
  Synthetic
ccgttttttttttttgagtgaag

SEQ ID NO: 13875 - DNA, 23 bp, Artificial Sequence
  Synthetic
ccgttttttttttttactggtac

SEQ ID NO: 13876 - DNA, 23 bp, Artificial Sequence
  Synthetic
ccgttttttttttttctcaagga

SEQ ID NO: 13877 - DNA, 23 bp, Artificial Sequence
  Synthetic
ccgttttttttttttccaagttc

SEQ ID NO: 13878 - DNA, 23 bp, Artificial Sequence
  Synthetic
ccgttttttttttttacttttgt

SEQ ID NO: 13879 - DNA, 23 bp, Artificial Sequence
  Synthetic
ccgttttttttttttgaaggcaa

SEQ ID NO: 13880 - DNA, 23 bp, Artificial Sequence
  Synthetic
ccgttttttttttttataggtca

SEQ ID NO: 13881 - DNA, 23 bp, Artificial Sequence
  Synthetic
ccgttttttttttttccctatca

SEQ ID NO: 13882 - DNA, 23 bp, Artificial Sequence
  Synthetic
ccgttttttttttttacaaacca

SEQ ID NO: 13883 - DNA, 23 bp, Artificial Sequence
  Synthetic
ccgttttttttttttaaaccatg

SEQ ID NO: 13884 - DNA, 23 bp, Artificial Sequence
  Synthetic
ccgttttttttttttgccaatat

SEQ ID NO: 13885 - DNA, 23 bp, Artificial Sequence
  Synthetic
ccgttttttttttttcaagtgcc

SEQ ID NO: 13886 - DNA, 23 bp, Artificial Sequence
  Synthetic
ccgttttttttttttctacctgc

SEQ ID NO: 13887 - DNA, 23 bp, Artificial Sequence
  Synthetic
ccgttttttttttttctcaccga

SEQ ID NO: 13888 - DNA, 23 bp, Artificial Sequence
  Synthetic
ccgttttttttttttgtacaatc

SEQ ID NO: 13889 - DNA, 23 bp, Artificial Sequence
  Synthetic
ccgttttttttttttccaccgac

SEQ ID NO: 13890 - DNA, 23 bp, Artificial Sequence
  Synthetic
ccgttttttttttttctcaccga

SEQ ID NO: 13891 - DNA, 23 bp, Artificial Sequence
  Synthetic
ccgttttttttttttacccaccg

SEQ ID NO: 13892 - DNA, 23 bp, Artificial Sequence
  Synthetic
ccgttttttttttttgagttcta

SEQ ID NO: 13893 - DNA, 23 bp, Artificial Sequence
  Synthetic
ccgttttttttttttgttggcaa

SEQ ID NO: 13894 - DNA, 23 bp, Artificial Sequence
  Synthetic
ccgttttttttttttagtgaatt

SEQ ID NO: 13895 - DNA, 23 bp, Artificial Sequence
  Synthetic
ccgttttttttttttcccttatc

SEQ ID NO: 13896 - DNA, 23 bp, Artificial Sequence
  Synthetic
ccgttttttttttttaactgcct

SEQ ID NO: 13897 - DNA, 23 bp, Artificial Sequence
  Synthetic
ccgttttttttttttagcccaaa

SEQ ID NO: 13898 - DNA, 23 bp, Artificial Sequence
  Synthetic
ccgttttttttttttggctgcaa

SEQ ID NO: 13899 - DNA, 23 bp, Artificial Sequence
  Synthetic
ccgttttttttttttccctccac

SEQ ID NO: 13900 - DNA, 23 bp, Artificial Sequence
  Synthetic
ccgttttttttttttctgatatc

SEQ ID NO: 13901 - DNA, 23 bp, Artificial Sequence
  Synthetic
ccgttttttttttttctgcacta

SEQ ID NO: 13902 - DNA, 23 bp, Artificial Sequence
  Synthetic
ccgttttttttttttgaaggagc

SEQ ID NO: 13903 - DNA, 23 bp, Artificial Sequence
  Synthetic
ccgttttttttttttactgcact

SEQ ID NO: 13904 - DNA, 23 bp, Artificial Sequence
  Synthetic
ccgttttttttttttcctaatat

SEQ ID NO: 13905 - DNA, 23 bp, Artificial Sequence
  Synthetic
ccgttttttttttttgctgcttt

SEQ ID NO: 13906 - DNA, 23 bp, Artificial Sequence
  Synthetic
ccgttttttttttttgggacgaa

SEQ ID NO: 13907 - DNA, 23 bp, Artificial Sequence
  Synthetic
ccgttttttttttttgctgtcaa

SEQ ID NO: 13908 - DNA, 23 bp, Artificial Sequence
  Synthetic
ccgttttttttttttgggacttt

SEQ ID NO: 13909 - DNA, 23 bp, Artificial Sequence
  Synthetic
ccgttttttttttttaagcggga

SEQ ID NO: 13910 - DNA, 23 bp, Artificial Sequence
  Synthetic
ccgttttttttttttcacatgga

SEQ ID NO: 13911 - DNA, 23 bp, Artificial Sequence
  Synthetic
ccgttttttttttttccaatatt

SEQ ID NO: 13912 - DNA, 23 bp, Artificial Sequence
  Synthetic
ccgttttttttttttcaacaaca

SEQ ID NO: 13913 - DNA, 23 bp, Artificial Sequence
  Synthetic
ccgttttttttttttcaacaaca

SEQ ID NO: 13914 - DNA, 23 bp, Artificial Sequence
  Synthetic
ccgttttttttttttctgggtgg

SEQ ID NO: 13915 - DNA, 23 bp, Artificial Sequence
  Synthetic
ccgttttttttttttctatctcc

SEQ ID NO: 13916 - DNA, 23 bp, Artificial Sequence
  Synthetic
ccgttttttttttttaacaggta

SEQ ID NO: 13917 - DNA, 23 bp, Artificial Sequence
  Synthetic
ccgttttttttttttaccaatgt

SEQ ID NO: 13918 - DNA, 23 bp, Artificial Sequence
  Synthetic
ccgttttttttttttaacagata

SEQ ID NO: 13919 - DNA, 23 bp, Artificial Sequence
  Synthetic
ccgttttttttttttagttttgc

SEQ ID NO: 13920 - DNA, 23 bp, Artificial Sequence
  Synthetic
ccgttttttttttttagttttgc

SEQ ID NO: 13921 - DNA, 23 bp, Artificial Sequence
  Synthetic
ccgttttttttttttcatcgtta

SEQ ID NO: 13922 - DNA, 23 bp, Artificial Sequence
  Synthetic
ccgttttttttttttcagcactg

SEQ ID NO: 13923 - DNA, 23 bp, Artificial Sequence
  Synthetic
ccgttttttttttttcatcatta

SEQ ID NO: 13924 - DNA, 23 bp, Artificial Sequence
  Synthetic
ccgttttttttttttcatcatta

SEQ ID NO: 13925 - DNA, 23 bp, Artificial Sequence
  Synthetic
ccgttttttttttttccatgccc

SEQ ID NO: 13926 - DNA, 23 bp, Artificial Sequence
  Synthetic
ccgttttttttttttaagaagta

SEQ ID NO: 13927 - DNA, 23 bp, Artificial Sequence
  Synthetic
ccgttttttttttttagtggtcc

SEQ ID NO: 13928 - DNA, 23 bp, Artificial Sequence
  Synthetic
ccgttttttttttttggcatagg

SEQ ID NO: 13929 - DNA, 23 bp, Artificial Sequence
  Synthetic
ccgttttttttttttagactccg

SEQ ID NO: 13930 - DNA, 23 bp, Artificial Sequence
  Synthetic
ccgttttttttttttcacacact

SEQ ID NO: 13931 - DNA, 23 bp, Artificial Sequence
  Synthetic
ccgttttttttttttcaagcttt

SEQ ID NO: 13932 - DNA, 23 bp, Artificial Sequence
  Synthetic
ccgttttttttttttacctgcac

SEQ ID NO: 13933 - DNA, 23 bp, Artificial Sequence
  Synthetic
ccgttttttttttttacctgcac

SEQ ID NO: 13934 - DNA, 23 bp, Artificial Sequence
  Synthetic
ccgttttttttttttaacatcag

SEQ ID NO: 13935 - DNA, 23 bp, Artificial Sequence
  Synthetic
ccgttttttttttttagccgctg

SEQ ID NO: 13936 - DNA, 23 bp, Artificial Sequence
  Synthetic
ccgttttttttttttggcgaagg

SEQ ID NO: 13937 - DNA, 23 bp, Artificial Sequence
  Synthetic
ccgttttttttttttgccgtgac

SEQ ID NO: 13938 - DNA, 23 bp, Artificial Sequence
  Synthetic
ccgttttttttttttgcctgtct

SEQ ID NO: 13939 - DNA, 23 bp, Artificial Sequence
  Synthetic
ccgttttttttttttctgtcaat

SEQ ID NO: 13940 - DNA, 23 bp, Artificial Sequence
  Synthetic
ccgttttttttttttacagttgc

SEQ ID NO: 13941 - DNA, 23 bp, Artificial Sequence
  Synthetic
ccgttttttttttttccaatcag

SEQ ID NO: 13942 - DNA, 23 bp, Artificial Sequence
  Synthetic
ccgttttttttttttcatggtta

SEQ ID NO: 13943 - DNA, 23 bp, Artificial Sequence
  Synthetic
ccgttttttttttttgaattgcg

SEQ ID NO: 13944 - DNA, 23 bp, Artificial Sequence
  Synthetic
ccgttttttttttttcagttctt

SEQ ID NO: 13945 - DNA, 23 bp, Artificial Sequence
  Synthetic
ccgttttttttttttaagtgtca

SEQ ID NO: 13946 - DNA, 23 bp, Artificial Sequence
  Synthetic
ccgttttttttttttaaacccag

SEQ ID NO: 13947 - DNA, 23 bp, Artificial Sequence
  Synthetic
ccgttttttttttttagacccag

SEQ ID NO: 13948 - DNA, 23 bp, Artificial Sequence
  Synthetic
ccgttttttttttttgggtattt

SEQ ID NO: 13949 - DNA, 23 bp, Artificial Sequence
  Synthetic
ccgttttttttttttaacggaac

SEQ ID NO: 13950 - DNA, 23 bp, Artificial Sequence
  Synthetic
ccgttttttttttttgaaatccc

SEQ ID NO: 13951 - DNA, 23 bp, Artificial Sequence
  Synthetic
ccgttttttttttttgtaatccc

SEQ ID NO: 13952 - DNA, 23 bp, Artificial Sequence
  Synthetic
ccgttttttttttttgttcctgc

SEQ ID NO: 13953 - DNA, 23 bp, Artificial Sequence
  Synthetic
ccgttttttttttttagaccgag

SEQ ID NO: 13954 - DNA, 23 bp, Artificial Sequence
  Synthetic
ccgttttttttttttcctatcct

SEQ ID NO: 13955 - DNA, 23 bp, Artificial Sequence
  Synthetic
ccgttttttttttttacctatcc

SEQ ID NO: 13956 - DNA, 23 bp, Artificial Sequence
  Synthetic
ccgttttttttttttcggaactt

SEQ ID NO: 13957 - DNA, 23 bp, Artificial Sequence
  Synthetic
ccgttttttttttttcagaactt

SEQ ID NO: 13958 - DNA, 23 bp, Artificial Sequence
  Synthetic
ccgttttttttttttcaatagac

SEQ ID NO: 13959 - DNA, 23 bp, Artificial Sequence
  Synthetic
ccgttttttttttttcaggattg

SEQ ID NO: 13960 - DNA, 23 bp, Artificial Sequence
  Synthetic
ccgttttttttttttagcggttt

SEQ ID NO: 13961 - DNA, 23 bp, Artificial Sequence
  Synthetic
ccgttttttttttttgtatgtgg

SEQ ID NO: 13962 - DNA, 23 bp, Artificial Sequence
  Synthetic
ccgttttttttttttaccgattt

SEQ ID NO: 13963 - DNA, 23 bp, Artificial Sequence
  Synthetic
ccgttttttttttttacactgat

SEQ ID NO: 13964 - DNA, 23 bp, Artificial Sequence
  Synthetic
ccgttttttttttttccgatttc

SEQ ID NO: 13965 - DNA, 23 bp, Artificial Sequence
  Synthetic
ccgttttttttttttctttgaca

SEQ ID NO: 13966 - DNA, 23 bp, Artificial Sequence
  Synthetic
ccgttttttttttttaccaaaac

SEQ ID NO: 13967 - DNA, 23 bp, Artificial Sequence
  Synthetic
ccgttttttttttttaagcaagt

SEQ ID NO: 13968 - DNA, 23 bp, Artificial Sequence
  Synthetic
ccgttttttttttttactaaaac

SEQ ID NO: 13969 - DNA, 23 bp, Artificial Sequence
  Synthetic
ccgttttttttttttgaaagcac

SEQ ID NO: 13970 - DNA, 23 bp, Artificial Sequence
  Synthetic
ccgttttttttttttcactgaaa

SEQ ID NO: 13971 - DNA, 23 bp, Artificial Sequence
  Synthetic
ccgttttttttttttagcaggta

SEQ ID NO: 13972 - DNA, 23 bp, Artificial Sequence
  Synthetic
ccgttttttttttttcactcaaa

SEQ ID NO: 13973 - DNA, 23 bp, Artificial Sequence
  Synthetic
ccgttttttttttttctgcaaac

SEQ ID NO: 13974 - DNA, 23 bp, Artificial Sequence
  Synthetic
ccgttttttttttttccagtcga

SEQ ID NO: 13975 - DNA, 23 bp, Artificial Sequence
  Synthetic
ccgttttttttttttgctgagtg

SEQ ID NO: 13976 - DNA, 23 bp, Artificial Sequence
  Synthetic
ccgttttttttttttctgagagt

SEQ ID NO: 13977 - DNA, 23 bp, Artificial Sequence
  Synthetic
ccgttttttttttttccagtcgg

SEQ ID NO: 13978 - DNA, 23 bp, Artificial Sequence
  Synthetic
ccgttttttttttttctgtaaac

SEQ ID NO: 13979 - DNA, 23 bp, Artificial Sequence
  Synthetic
ccgttttttttttttcagtcaag

SEQ ID NO: 13980 - DNA, 23 bp, Artificial Sequence
  Synthetic
ccgttttttttttttagctatgc

SEQ ID NO: 13981 - DNA, 23 bp, Artificial Sequence
  Synthetic
ccgttttttttttttcaacttag

SEQ ID NO: 13982 - DNA, 23 bp, Artificial Sequence
  Synthetic
ccgttttttttttttgccctctc

SEQ ID NO: 13983 - DNA, 23 bp, Artificial Sequence
  Synthetic
ccgttttttttttttgaggtcga

SEQ ID NO: 13984 - DNA, 23 bp, Artificial Sequence
  Synthetic
ccgttttttttttttcagcagca

SEQ ID NO: 13985 - DNA, 23 bp, Artificial Sequence
  Synthetic
ccgttttttttttttcaccaatg

SEQ ID NO: 13986 - DNA, 23 bp, Artificial Sequence
  Synthetic
ccgttttttttttttcacttact

SEQ ID NO: 13987 - DNA, 23 bp, Artificial Sequence
  Synthetic
ccgttttttttttttggaggaag

SEQ ID NO: 13988 - DNA, 23 bp, Artificial Sequence
  Synthetic
ccgttttttttttttcggaaggg

SEQ ID NO: 13989 - DNA, 23 bp, Artificial Sequence
  Synthetic
ccgttttttttttttaagaggtt

SEQ ID NO: 13990 - DNA, 23 bp, Artificial Sequence
  Synthetic
ccgttttttttttttaatgcaac

SEQ ID NO: 13991 - DNA, 23 bp, Artificial Sequence
  Synthetic
ccgttttttttttttctgcaggc

SEQ ID NO: 13992 - DNA, 23 bp, Artificial Sequence
  Synthetic
ccgttttttttttttaggatagg

SEQ ID NO: 13993 - DNA, 23 bp, Artificial Sequence
  Synthetic
ccgttttttttttttcatttttc

SEQ ID NO: 13994 - DNA, 23 bp, Artificial Sequence
  Synthetic
ccgttttttttttttaaggcatc

SEQ ID NO: 13995 - DNA, 23 bp, Artificial Sequence
  Synthetic
ccgttttttttttttaacaaaat

SEQ ID NO: 13996 - DNA, 23 bp, Artificial Sequence
  Synthetic
ccgttttttttttttagctcctg

SEQ ID NO: 13997 - DNA, 23 bp, Artificial Sequence
  Synthetic
ccgttttttttttttcaatgcaa

SEQ ID NO: 13998 - DNA, 23 bp, Artificial Sequence
  Synthetic
ccgttttttttttttgctataaa

SEQ ID NO: 13999 - DNA, 23 bp, Artificial Sequence
  Synthetic
ccgttttttttttttacgggtgc

SEQ ID NO: 14000 - DNA, 23 bp, Artificial Sequence
  Synthetic
ccgttttttttttttccctggac

SEQ ID NO: 14001 - DNA, 23 bp, Artificial Sequence
  Synthetic
ccgttttttttttttgaggcagg

SEQ ID NO: 14002 - DNA, 23 bp, Artificial Sequence
  Synthetic
ccgttttttttttttacaaccag

SEQ ID NO: 14003 - DNA, 23 bp, Artificial Sequence
  Synthetic
ccgttttttttttttaatcagct

SEQ ID NO: 14004 - DNA, 23 bp, Artificial Sequence
  Synthetic
ccgttttttttttttcaatcagc

SEQ ID NO: 14005 - DNA, 23 bp, Artificial Sequence
  Synthetic
ccgttttttttttttacccctgg

SEQ ID NO: 14006 - DNA, 23 bp, Artificial Sequence
  Synthetic
ccgttttttttttttctcacacc

SEQ ID NO: 14007 - DNA, 23 bp, Artificial Sequence
  Synthetic
ccgttttttttttttcagatgga

SEQ ID NO: 14008 - DNA, 23 bp, Artificial Sequence
  Synthetic
ccgttttttttttttaattgcat

SEQ ID NO: 14009 - DNA, 23 bp, Artificial Sequence
  Synthetic
ccgttttttttttttaaggattt

SEQ ID NO: 14010 - DNA, 23 bp, Artificial Sequence
  Synthetic
ccgttttttttttttaccattgc

SEQ ID NO: 14011 - DNA, 23 bp, Artificial Sequence
  Synthetic
ccgttttttttttttaacgtgga

SEQ ID NO: 14012 - DNA, 23 bp, Artificial Sequence
  Synthetic
ccgttttttttttttaagatcaa

SEQ ID NO: 14013 - DNA, 23 bp, Artificial Sequence
  Synthetic
ccgttttttttttttcgaatata

SEQ ID NO: 14014 - DNA, 23 bp, Artificial Sequence
  Synthetic
ccgttttttttttttcaggttcc

SEQ ID NO: 14015 - DNA, 23 bp, Artificial Sequence
  Synthetic
ccgttttttttttttcactcaaa

SEQ ID NO: 14016 - DNA, 23 bp, Artificial Sequence
  Synthetic
ccgttttttttttttcgctcaaa

SEQ ID NO: 14017 - DNA, 23 bp, Artificial Sequence
  Synthetic
ccgttttttttttttcaccccaa

SEQ ID NO: 14018 - DNA, 23 bp, Artificial Sequence
  Synthetic
ccgttttttttttttgaaagcgc

SEQ ID NO: 14019 - DNA, 23 bp, Artificial Sequence
  Synthetic
ccgttttttttttttacttatca

SEQ ID NO: 14020 - DNA, 23 bp, Artificial Sequence
  Synthetic
ccgttttttttttttacgcgagc

SEQ ID NO: 14021 - DNA, 23 bp, Artificial Sequence
  Synthetic
ccgttttttttttttcgtggatt

SEQ ID NO: 14022 - DNA, 23 bp, Artificial Sequence
  Synthetic
ccgttttttttttttcatagaag

SEQ ID NO: 14023 - DNA, 23 bp, Artificial Sequence
  Synthetic
ccgttttttttttttacatggat

SEQ ID NO: 14024 - DNA, 23 bp, Artificial Sequence
  Synthetic
ccgttttttttttttcaaaagtt

SEQ ID NO: 14025 - DNA, 23 bp, Artificial Sequence
  Synthetic
ccgttttttttttttcacaggac

SEQ ID NO: 14026 - DNA, 23 bp, Artificial Sequence
  Synthetic
ccgttttttttttttcgttccat

SEQ ID NO: 14027 - DNA, 23 bp, Artificial Sequence
  Synthetic
ccgttttttttttttagatgtgg

SEQ ID NO: 14028 - DNA, 23 bp, Artificial Sequence
  Synthetic
ccgttttttttttttcgcatgtt

SEQ ID NO: 14029 - DNA, 23 bp, Artificial Sequence
  Synthetic
ccgttttttttttttcagagagc

SEQ ID NO: 14030 - DNA, 23 bp, Artificial Sequence
  Synthetic
ccgttttttttttttgaatccac

SEQ ID NO: 14031 - DNA, 23 bp, Artificial Sequence
  Synthetic
ccgttttttttttttgccacaat

SEQ ID NO: 14032 - DNA, 23 bp, Artificial Sequence
  Synthetic
ccgttttttttttttgaacaatt

SEQ ID NO: 14033 - DNA, 23 bp, Artificial Sequence
  Synthetic
ccgttttttttttttggggttca

SEQ ID NO: 14034 - DNA, 23 bp, Artificial Sequence
  Synthetic
ccgttttttttttttcaaagttg

SEQ ID NO: 14035 - DNA, 23 bp, Artificial Sequence
  Synthetic
ccgttttttttttttcaggccat

SEQ ID NO: 14036 - DNA, 23 bp, Artificial Sequence
  Synthetic
ccgttttttttttttgtacgcta

SEQ ID NO: 14037 - DNA, 23 bp, Artificial Sequence
  Synthetic
ccgttttttttttttcggctagt

SEQ ID NO: 14038 - DNA, 23 bp, Artificial Sequence
  Synthetic
ccgttttttttttttcgcccaat

SEQ ID NO: 14039 - DNA, 23 bp, Artificial Sequence
  Synthetic
ccgttttttttttttgccttctg

SEQ ID NO: 14040 - DNA, 23 bp, Artificial Sequence
  Synthetic
ccgttttttttttttgccttctg

SEQ ID NO: 14041 - DNA, 23 bp, Artificial Sequence
  Synthetic
ccgttttttttttttgaggggcc

SEQ ID NO: 14042 - DNA, 23 bp, Artificial Sequence
  Synthetic
ccgttttttttttttaaaacatg

SEQ ID NO: 14043 - DNA, 23 bp, Artificial Sequence
  Synthetic
ccgttttttttttttgcggacac

SEQ ID NO: 14044 - DNA, 23 bp, Artificial Sequence
  Synthetic
ccgttttttttttttaacgggag

SEQ ID NO: 14045 - DNA, 23 bp, Artificial Sequence
  Synthetic
ccgttttttttttttcggtttta

SEQ ID NO: 14046 - DNA, 23 bp, Artificial Sequence
  Synthetic
ccgttttttttttttcatgacgg

SEQ ID NO: 14047 - DNA, 23 bp, Artificial Sequence
  Synthetic
ccgttttttttttttcacccaat

SEQ ID NO: 14048 - DNA, 23 bp, Artificial Sequence
  Synthetic
ccgttttttttttttgacatgga

SEQ ID NO: 14049 - DNA, 23 bp, Artificial Sequence
  Synthetic
ccgttttttttttttcaccgagg

SEQ ID NO: 14050 - DNA, 23 bp, Artificial Sequence
  Synthetic
ccgttttttttttttgggacatc

SEQ ID NO: 14051 - DNA, 23 bp, Artificial Sequence
  Synthetic
ccgttttttttttttccagctaa

SEQ ID NO: 14052 - DNA, 23 bp, Artificial Sequence
  Synthetic
ccgttttttttttttccagctaa

SEQ ID NO: 14053 - DNA, 23 bp, Artificial Sequence
  Synthetic
ccgttttttttttttaggaacac

SEQ ID NO: 14054 - DNA, 23 bp, Artificial Sequence
  Synthetic
ccgttttttttttttaactcagt

SEQ ID NO: 14055 - DNA, 23 bp, Artificial Sequence
  Synthetic
ccgttttttttttttctcagttt

SEQ ID NO: 14056 - DNA, 23 bp, Artificial Sequence
  Synthetic
ccgttttttttttttctttgcag

SEQ ID NO: 14057 - DNA, 23 bp, Artificial Sequence
  Synthetic
ccgttttttttttttgaactcac

SEQ ID NO: 14058 - DNA, 23 bp, Artificial Sequence
  Synthetic
ccgttttttttttttaaccctat

SEQ ID NO: 14059 - DNA, 23 bp, Artificial Sequence
  Synthetic
ccgttttttttttttcagagaca

SEQ ID NO: 14060 - DNA, 23 bp, Artificial Sequence
  Synthetic
ccgttttttttttttgatgtagt

SEQ ID NO: 14061 - DNA, 23 bp, Artificial Sequence
  Synthetic
ccgttttttttttttgaagacgg

SEQ ID NO: 14062 - DNA, 23 bp, Artificial Sequence
  Synthetic
ccgttttttttttttcgggaggg

SEQ ID NO: 14063 - DNA, 23 bp, Artificial Sequence
  Synthetic
ccgttttttttttttgagaggag

SEQ ID NO: 14064 - DNA, 23 bp, Artificial Sequence
  Synthetic
ccgttttttttttttaattcatc

SEQ ID NO: 14065 - DNA, 23 bp, Artificial Sequence
  Synthetic
ccgttttttttttttcggggcag

SEQ ID NO: 14066 - DNA, 23 bp, Artificial Sequence
  Synthetic
ccgttttttttttttactggatg

SEQ ID NO: 14067 - DNA, 23 bp, Artificial Sequence
  Synthetic
ccgttttttttttttagtggatg

SEQ ID NO: 14068 - DNA, 23 bp, Artificial Sequence
  Synthetic
ccgttttttttttttagagtgcc

SEQ ID NO: 14069 - DNA, 23 bp, Artificial Sequence
  Synthetic
ccgttttttttttttctgccgta

SEQ ID NO: 14070 - DNA, 23 bp, Artificial Sequence
  Synthetic
ccgttttttttttttagcatgga

SEQ ID NO: 14071 - DNA, 23 bp, Artificial Sequence
  Synthetic
ccgttttttttttttctcatgga

SEQ ID NO: 14072 - DNA, 23 bp, Artificial Sequence
  Synthetic
ccgttttttttttttagaatctt

SEQ ID NO: 14073 - DNA, 23 bp, Artificial Sequence
  Synthetic
ccgttttttttttttggcacaca

SEQ ID NO: 14074 - DNA, 23 bp, Artificial Sequence
  Synthetic
ccgttttttttttttatgaaagc

SEQ ID NO: 14075 - DNA, 23 bp, Artificial Sequence
  Synthetic
ccgttttttttttttagaggttt

SEQ ID NO: 14076 - DNA, 23 bp, Artificial Sequence
  Synthetic
ccgttttttttttttaagaagtg

SEQ ID NO: 14077 - DNA, 23 bp, Artificial Sequence
  Synthetic
ccgttttttttttttagattggc

SEQ ID NO: 14078 - DNA, 23 bp, Artificial Sequence
  Synthetic
ccgttttttttttttcaaaccac

SEQ ID NO: 14079 - DNA, 23 bp, Artificial Sequence
  Synthetic
ccgttttttttttttaaaaacgc

SEQ ID NO: 14080 - DNA, 23 bp, Artificial Sequence
  Synthetic
ccgttttttttttttaacatcac

SEQ ID NO: 14081 - DNA, 23 bp, Artificial Sequence
  Synthetic
ccgttttttttttttagaatcct

SEQ ID NO: 14082 - DNA, 23 bp, Artificial Sequence
  Synthetic
ccgttttttttttttcacccagg

SEQ ID NO: 14083 - DNA, 23 bp, Artificial Sequence
  Synthetic
ccgttttttttttttgcacccag

SEQ ID NO: 14084 - DNA, 23 bp, Artificial Sequence
  Synthetic
ccgttttttttttttgcagaact

SEQ ID NO: 14085 - DNA, 23 bp, Artificial Sequence
  Synthetic
ccgttttttttttttagagtgca

SEQ ID NO: 14086 - DNA, 23 bp, Artificial Sequence
  Synthetic
ccgttttttttttttaggaaacc

SEQ ID NO: 14087 - DNA, 23 bp, Artificial Sequence
  Synthetic
ccgttttttttttttactcagaa

SEQ ID NO: 14088 - DNA, 23 bp, Artificial Sequence
  Synthetic
ccgttttttttttttactccaaa

SEQ ID NO: 14089 - DNA, 23 bp, Artificial Sequence
  Synthetic
ccgttttttttttttactccaaa

SEQ ID NO: 14090 - DNA, 23 bp, Artificial Sequence
  Synthetic
ccgttttttttttttacccacag

SEQ ID NO: 14091 - DNA, 23 bp, Artificial Sequence
  Synthetic
ccgttttttttttttgattgcca

SEQ ID NO: 14092 - DNA, 23 bp, Artificial Sequence
  Synthetic
ccgttttttttttttactgcaga

SEQ ID NO: 14093 - DNA, 23 bp, Artificial Sequence
  Synthetic
ccgttttttttttttacctcagc

SEQ ID NO: 14094 - DNA, 23 bp, Artificial Sequence
  Synthetic
ccgttttttttttttaaagtgcc

SEQ ID NO: 14095 - DNA, 23 bp, Artificial Sequence
  Synthetic
ccgttttttttttttaaatgaca

SEQ ID NO: 14096 - DNA, 23 bp, Artificial Sequence
  Synthetic
ccgttttttttttttactcacag

SEQ ID NO: 14097 - DNA, 23 bp, Artificial Sequence
  Synthetic
ccgttttttttttttcgctccaa

SEQ ID NO: 14098 - DNA, 23 bp, Artificial Sequence
  Synthetic
ccgttttttttttttagaaagtg

SEQ ID NO: 14099 - DNA, 23 bp, Artificial Sequence
  Synthetic
ccgttttttttttttccctctga

SEQ ID NO: 14100 - DNA, 23 bp, Artificial Sequence
  Synthetic
ccgttttttttttttaagtgctt

SEQ ID NO: 14101 - DNA, 23 bp, Artificial Sequence
  Synthetic
ccgttttttttttttgacagtgc

SEQ ID NO: 14102 - DNA, 23 bp, Artificial Sequence
  Synthetic
ccgttttttttttttacactcta

SEQ ID NO: 14103 - DNA, 23 bp, Artificial Sequence
  Synthetic
ccgttttttttttttacactcta

SEQ ID NO: 14104 - DNA, 23 bp, Artificial Sequence
  Synthetic
ccgttttttttttttcactctaa

SEQ ID NO: 14105 - DNA, 23 bp, Artificial Sequence
  Synthetic
ccgttttttttttttcagcaaag

SEQ ID NO: 14106 - DNA, 23 bp, Artificial Sequence
  Synthetic
ccgttttttttttttcctctaaa

SEQ ID NO: 14107 - DNA, 23 bp, Artificial Sequence
  Synthetic
ccgttttttttttttactctaaa

SEQ ID NO: 14108 - DNA, 23 bp, Artificial Sequence
  Synthetic
ccgttttttttttttagaaagtg

SEQ ID NO: 14109 - DNA, 23 bp, Artificial Sequence
  Synthetic
ccgttttttttttttctccaaag

SEQ ID NO: 14110 - DNA, 23 bp, Artificial Sequence
  Synthetic
ccgttttttttttttcactctga

SEQ ID NO: 14111 - DNA, 23 bp, Artificial Sequence
  Synthetic
ccgttttttttttttctctaaag

SEQ ID NO: 14112 - DNA, 23 bp, Artificial Sequence
  Synthetic
ccgttttttttttttgagaaagt

SEQ ID NO: 14113 - DNA, 23 bp, Artificial Sequence
  Synthetic
ccgttttttttttttaacactct

SEQ ID NO: 14114 - DNA, 23 bp, Artificial Sequence
  Synthetic
ccgttttttttttttaacctcta

SEQ ID NO: 14115 - DNA, 23 bp, Artificial Sequence
  Synthetic
ccgttttttttttttcctctaaa

SEQ ID NO: 14116 - DNA, 23 bp, Artificial Sequence
  Synthetic
ccgttttttttttttcactctaa

SEQ ID NO: 14117 - DNA, 23 bp, Artificial Sequence
  Synthetic
ccgttttttttttttcactctaa

SEQ ID NO: 14118 - DNA, 23 bp, Artificial Sequence
  Synthetic
ccgttttttttttttaaagtgct

SEQ ID NO: 14119 - DNA, 23 bp, Artificial Sequence
  Synthetic
ccgttttttttttttcagtccaa

SEQ ID NO: 14120 - DNA, 23 bp, Artificial Sequence
  Synthetic
ccgttttttttttttgaaagtac

SEQ ID NO: 14121 - DNA, 23 bp, Artificial Sequence
  Synthetic
ccgttttttttttttcctctaaa

SEQ ID NO: 14122 - DNA, 23 bp, Artificial Sequence
  Synthetic
ccgttttttttttttaccctcta

SEQ ID NO: 14123 - DNA, 23 bp, Artificial Sequence
  Synthetic
ccgttttttttttttacccacca

SEQ ID NO: 14124 - DNA, 23 bp, Artificial Sequence
  Synthetic
ccgttttttttttttagaaaggg

SEQ ID NO: 14125 - DNA, 23 bp, Artificial Sequence
  Synthetic
ccgttttttttttttcctcaaaa

SEQ ID NO: 14126 - DNA, 23 bp, Artificial Sequence
  Synthetic
ccgttttttttttttaccctcta

SEQ ID NO: 14127 - DNA, 23 bp, Artificial Sequence
  Synthetic
ccgttttttttttttcactctaa

SEQ ID NO: 14128 - DNA, 23 bp, Artificial Sequence
  Synthetic
ccgttttttttttttctctaaag

SEQ ID NO: 14129 - DNA, 23 bp, Artificial Sequence
  Synthetic
ccgttttttttttttcactctaa

SEQ ID NO: 14130 - DNA, 23 bp, Artificial Sequence
  Synthetic
ccgttttttttttttacactcta

SEQ ID NO: 14131 - DNA, 23 bp, Artificial Sequence
  Synthetic
ccgttttttttttttcctctata

SEQ ID NO: 14132 - DNA, 23 bp, Artificial Sequence
  Synthetic
ccgttttttttttttctccaaag

SEQ ID NO: 14133 - DNA, 23 bp, Artificial Sequence
  Synthetic
ccgttttttttttttagaaagtg

SEQ ID NO: 14134 - DNA, 23 bp, Artificial Sequence
  Synthetic
ccgttttttttttttgaaagtgc

SEQ ID NO: 14135 - DNA, 23 bp, Artificial Sequence
  Synthetic
ccgttttttttttttctctaaag

SEQ ID NO: 14136 - DNA, 23 bp, Artificial Sequence
  Synthetic
ccgttttttttttttgaaagtgc

SEQ ID NO: 14137 - DNA, 23 bp, Artificial Sequence
  Synthetic
ccgttttttttttttacagaaag

SEQ ID NO: 14138 - DNA, 23 bp, Artificial Sequence
  Synthetic
ccgttttttttttttcctctaaa

SEQ ID NO: 14139 - DNA, 23 bp, Artificial Sequence
  Synthetic
ccgttttttttttttacagaaag

SEQ ID NO: 14140 - DNA, 23 bp, Artificial Sequence
  Synthetic
ccgttttttttttttgaaagggc

SEQ ID NO: 14141 - DNA, 23 bp, Artificial Sequence
  Synthetic
ccgttttttttttttcggtccta

SEQ ID NO: 14142 - DNA, 23 bp, Artificial Sequence
  Synthetic
ccgttttttttttttcacaccaa

SEQ ID NO: 14143 - DNA, 23 bp, Artificial Sequence
  Synthetic
ccgttttttttttttagttatca

SEQ ID NO: 14144 - DNA, 23 bp, Artificial Sequence
  Synthetic
ccgttttttttttttcgtgacat

SEQ ID NO: 14145 - DNA, 23 bp, Artificial Sequence
  Synthetic
ccgttttttttttttcttgctaa

SEQ ID NO: 14146 - DNA, 23 bp, Artificial Sequence
  Synthetic
ccgttttttttttttacacaata

SEQ ID NO: 14147 - DNA, 23 bp, Artificial Sequence
  Synthetic
ccgttttttttttttcaaaagta

SEQ ID NO: 14148 - DNA, 23 bp, Artificial Sequence
  Synthetic
ccgttttttttttttcaaaagca

SEQ ID NO: 14149 - DNA, 23 bp, Artificial Sequence
  Synthetic
ccgttttttttttttcaaaagta

SEQ ID NO: 14150 - DNA, 23 bp, Artificial Sequence
  Synthetic
ccgttttttttttttcaaaagaa

SEQ ID NO: 14151 - DNA, 23 bp, Artificial Sequence
  Synthetic
ccgttttttttttttgagctcat

SEQ ID NO: 14152 - DNA, 23 bp, Artificial Sequence
  Synthetic
ccgttttttttttttgtgcctga

SEQ ID NO: 14153 - DNA, 23 bp, Artificial Sequence
  Synthetic
ccgttttttttttttgaaaccaa

SEQ ID NO: 14154 - DNA, 23 bp, Artificial Sequence
  Synthetic
ccgttttttttttttgaaaccaa

SEQ ID NO: 14155 - DNA, 23 bp, Artificial Sequence
  Synthetic
ccgttttttttttttctaaccag

SEQ ID NO: 14156 - DNA, 23 bp, Artificial Sequence
  Synthetic
ccgttttttttttttaaacaaaa

SEQ ID NO: 14157 - DNA, 23 bp, Artificial Sequence
  Synthetic
ccgttttttttttttctggctga

SEQ ID NO: 14158 - DNA, 23 bp, Artificial Sequence
  Synthetic
ccgttttttttttttcagaggtt

SEQ ID NO: 14159 - DNA, 23 bp, Artificial Sequence
  Synthetic
ccgttttttttttttatattaca

SEQ ID NO: 14160 - DNA, 23 bp, Artificial Sequence
  Synthetic
ccgttttttttttttgacaaggc

SEQ ID NO: 14161 - DNA, 23 bp, Artificial Sequence
  Synthetic
ccgttttttttttttggtacagc

SEQ ID NO: 14162 - DNA, 23 bp, Artificial Sequence
  Synthetic
ccgttttttttttttgtgcatat

SEQ ID NO: 14163 - DNA, 23 bp, Artificial Sequence
  Synthetic
ccgttttttttttttgcggccgg

SEQ ID NO: 14164 - DNA, 23 bp, Artificial Sequence
  Synthetic
ccgttttttttttttcttcaagg

SEQ ID NO: 14165 - DNA, 23 bp, Artificial Sequence
  Synthetic
ccgttttttttttttcaaatggt

SEQ ID NO: 14166 - DNA, 23 bp, Artificial Sequence
  Synthetic
ccgttttttttttttggaaacgt

SEQ ID NO: 14167 - DNA, 23 bp, Artificial Sequence
  Synthetic
ccgttttttttttttcctgctga

SEQ ID NO: 14168 - DNA, 23 bp, Artificial Sequence
  Synthetic
ccgttttttttttttaacagaca

SEQ ID NO: 14169 - DNA, 23 bp, Artificial Sequence
  Synthetic
ccgttttttttttttgggatcac

SEQ ID NO: 14170 - DNA, 23 bp, Artificial Sequence
  Synthetic
ccgttttttttttttctgtcctg

SEQ ID NO: 14171 - DNA, 23 bp, Artificial Sequence
  Synthetic
ccgttttttttttttgtgtatac

SEQ ID NO: 14172 - DNA, 23 bp, Artificial Sequence
  Synthetic
ccgttttttttttttctttccag

SEQ ID NO: 14173 - DNA, 23 bp, Artificial Sequence
  Synthetic
ccgttttttttttttcaaaggta

SEQ ID NO: 14174 - DNA, 23 bp, Artificial Sequence
  Synthetic
ccgttttttttttttcactcaga

SEQ ID NO: 14175 - DNA, 23 bp, Artificial Sequence
  Synthetic
ccgttttttttttttggccaccg

SEQ ID NO: 14176 - DNA, 23 bp, Artificial Sequence
  Synthetic
ccgttttttttttttgatcagtt

SEQ ID NO: 14177 - DNA, 23 bp, Artificial Sequence
  Synthetic
ccgttttttttttttgggtgtgt

SEQ ID NO: 14178 - DNA, 23 bp, Artificial Sequence
  Synthetic
ccgttttttttttttctcctgtc

SEQ ID NO: 14179 - DNA, 23 bp, Artificial Sequence
  Synthetic
ccgttttttttttttaaagacgt

SEQ ID NO: 14180 - DNA, 23 bp, Artificial Sequence
  Synthetic
ccgttttttttttttaggtacca

SEQ ID NO: 14181 - DNA, 23 bp, Artificial Sequence
  Synthetic
ccgttttttttttttcaatccta

SEQ ID NO: 14182 - DNA, 23 bp, Artificial Sequence
  Synthetic
ccgttttttttttttcgcggttt

SEQ ID NO: 14183 - DNA, 23 bp, Artificial Sequence
  Synthetic
ccgttttttttttttctaatgat

SEQ ID NO: 14184 - DNA, 23 bp, Artificial Sequence
  Synthetic
ccgttttttttttttctgatcta

SEQ ID NO: 14185 - DNA, 23 bp, Artificial Sequence
  Synthetic
ccgttttttttttttgtaactgg

SEQ ID NO: 14186 - DNA, 23 bp, Artificial Sequence
  Synthetic
ccgttttttttttttaatgggac

SEQ ID NO: 14187 - DNA, 23 bp, Artificial Sequence
  Synthetic
ccgttttttttttttcagtccca

SEQ ID NO: 14188 - DNA, 23 bp, Artificial Sequence
  Synthetic
ccgttttttttttttgcatacag

SEQ ID NO: 14189 - DNA, 23 bp, Artificial Sequence
  Synthetic
ccgttttttttttttgacctaaa

SEQ ID NO: 14190 - DNA, 23 bp, Artificial Sequence
  Synthetic
ccgttttttttttttgactcatc

SEQ ID NO: 14191 - DNA, 23 bp, Artificial Sequence
  Synthetic
ccgttttttttttttctaaccca

SEQ ID NO: 14192 - DNA, 23 bp, Artificial Sequence
  Synthetic
ccgttttttttttttgggaaccg

SEQ ID NO: 14193 - DNA, 23 bp, Artificial Sequence
  Synthetic
ccgttttttttttttgcactttt

SEQ ID NO: 14194 - DNA, 23 bp, Artificial Sequence
  Synthetic
ccgttttttttttttcaatgaga

SEQ ID NO: 14195 - DNA, 23 bp, Artificial Sequence
  Synthetic
ccgttttttttttttcatcatcg

SEQ ID NO: 14196 - DNA, 23 bp, Artificial Sequence
  Synthetic
ccgttttttttttttctgagcaa

SEQ ID NO: 14197 - DNA, 23 bp, Artificial Sequence
  Synthetic
ccgttttttttttttaagtcaca

SEQ ID NO: 14198 - DNA, 23 bp, Artificial Sequence
  Synthetic
ccgttttttttttttgacacacc

SEQ ID NO: 14199 - DNA, 23 bp, Artificial Sequence
  Synthetic
ccgttttttttttttccgaggag

SEQ ID NO: 14200 - DNA, 23 bp, Artificial Sequence
  Synthetic
ccgttttttttttttcagtggtc

SEQ ID NO: 14201 - DNA, 23 bp, Artificial Sequence
  Synthetic
ccgttttttttttttacgatgac

SEQ ID NO: 14202 - DNA, 23 bp, Artificial Sequence
  Synthetic
ccgttttttttttttgataaact

SEQ ID NO: 14203 - DNA, 23 bp, Artificial Sequence
  Synthetic
ccgttttttttttttagcaaggc

SEQ ID NO: 14204 - DNA, 23 bp, Artificial Sequence
  Synthetic
ccgttttttttttttcctccaac

SEQ ID NO: 14205 - DNA, 23 bp, Artificial Sequence
  Synthetic
ccgttttttttttttggccgcag

SEQ ID NO: 14206 - DNA, 23 bp, Artificial Sequence
  Synthetic
ccgttttttttttttcaaaagta

SEQ ID NO: 14207 - DNA, 23 bp, Artificial Sequence
  Synthetic
ccgttttttttttttcctgaatt

SEQ ID NO: 14208 - DNA, 23 bp, Artificial Sequence
  Synthetic
ccgttttttttttttggagaagg

SEQ ID NO: 14209 - DNA, 23 bp, Artificial Sequence
  Synthetic
ccgttttttttttttctttgatt

SEQ ID NO: 14210 - DNA, 23 bp, Artificial Sequence
  Synthetic
ccgttttttttttttatagatct

SEQ ID NO: 14211 - DNA, 23 bp, Artificial Sequence
  Synthetic
ccgttttttttttttcggagctg

SEQ ID NO: 14212 - DNA, 23 bp, Artificial Sequence
  Synthetic
ccgttttttttttttgagatgag

SEQ ID NO: 14213 - DNA, 23 bp, Artificial Sequence
  Synthetic
ccgttttttttttttccagcaca

SEQ ID NO: 14214 - DNA, 23 bp, Artificial Sequence
  Synthetic
ccgttttttttttttcagacccc

SEQ ID NO: 14215 - DNA, 23 bp, Artificial Sequence
  Synthetic
ccgttttttttttttaggagctc

SEQ ID NO: 14216 - DNA, 23 bp, Artificial Sequence
  Synthetic
ccgttttttttttttgcaaagaa

SEQ ID NO: 14217 - DNA, 23 bp, Artificial Sequence
  Synthetic
ccgttttttttttttcacctggc

SEQ ID NO: 14218 - DNA, 23 bp, Artificial Sequence
  Synthetic
ccgttttttttttttgagggaga

SEQ ID NO: 14219 - DNA, 23 bp, Artificial Sequence
  Synthetic
ccgttttttttttttagtcactg

SEQ ID NO: 14220 - DNA, 23 bp, Artificial Sequence
  Synthetic
ccgttttttttttttccaccttc

SEQ ID NO: 14221 - DNA, 23 bp, Artificial Sequence
  Synthetic
ccgttttttttttttctcagaag

SEQ ID NO: 14222 - DNA, 23 bp, Artificial Sequence
  Synthetic
ccgttttttttttttctgggcac

SEQ ID NO: 14223 - DNA, 23 bp, Artificial Sequence
  Synthetic
ccgttttttttttttctatatct

SEQ ID NO: 14224 - DNA, 23 bp, Artificial Sequence
  Synthetic
ccgttttttttttttggtaagcg

SEQ ID NO: 14225 - DNA, 23 bp, Artificial Sequence
  Synthetic
ccgttttttttttttctccaacc

SEQ ID NO: 14226 - DNA, 23 bp, Artificial Sequence
  Synthetic
ccgttttttttttttcccaacag

SEQ ID NO: 14227 - DNA, 23 bp, Artificial Sequence
  Synthetic
ccgttttttttttttaacacaag

SEQ ID NO: 14228 - DNA, 23 bp, Artificial Sequence
  Synthetic
ccgttttttttttttggactata

SEQ ID NO: 14229 - DNA, 23 bp, Artificial Sequence
  Synthetic
ccgttttttttttttagacattt

SEQ ID NO: 14230 - DNA, 23 bp, Artificial Sequence
  Synthetic
ccgttttttttttttctcttttc

SEQ ID NO: 14231 - DNA, 23 bp, Artificial Sequence
  Synthetic
ccgttttttttttttgactgcca

SEQ ID NO: 14232 - DNA, 23 bp, Artificial Sequence
  Synthetic
ccgttttttttttttctgggctt

SEQ ID NO: 14233 - DNA, 23 bp, Artificial Sequence
  Synthetic
ccgttttttttttttccttccct

SEQ ID NO: 14234 - DNA, 23 bp, Artificial Sequence
  Synthetic
ccgttttttttttttctgaggtc

SEQ ID NO: 14235 - DNA, 23 bp, Artificial Sequence
  Synthetic
ccgttttttttttttccacagga

SEQ ID NO: 14236 - DNA, 23 bp, Artificial Sequence
  Synthetic
ccgttttttttttttgtggtaga

SEQ ID NO: 14237 - DNA, 23 bp, Artificial Sequence
  Synthetic
ccgttttttttttttccaaagtt

SEQ ID NO: 14238 - DNA, 23 bp, Artificial Sequence
  Synthetic
ccgttttttttttttgacattgt

SEQ ID NO: 14239 - DNA, 23 bp, Artificial Sequence
  Synthetic
ccgttttttttttttgcgggcgg

SEQ ID NO: 14240 - DNA, 23 bp, Artificial Sequence
  Synthetic
ccgttttttttttttcgcagagc

SEQ ID NO: 14241 - DNA, 23 bp, Artificial Sequence
  Synthetic
ccgttttttttttttggccgcca

SEQ ID NO: 14242 - DNA, 23 bp, Artificial Sequence
  Synthetic
ccgttttttttttttcagcgctc

SEQ ID NO: 14243 - DNA, 23 bp, Artificial Sequence
  Synthetic
ccgttttttttttttgaggcagg

SEQ ID NO: 14244 - DNA, 23 bp, Artificial Sequence
  Synthetic
ccgttttttttttttaggtgact

SEQ ID NO: 14245 - DNA, 23 bp, Artificial Sequence
  Synthetic
ccgttttttttttttaagacaca

SEQ ID NO: 14246 - DNA, 23 bp, Artificial Sequence
  Synthetic
ccgttttttttttttacctgagc

SEQ ID NO: 14247 - DNA, 23 bp, Artificial Sequence
  Synthetic
ccgttttttttttttctctaaga

SEQ ID NO: 14248 - DNA, 23 bp, Artificial Sequence
  Synthetic
ccgttttttttttttagcagtac

SEQ ID NO: 14249 - DNA, 23 bp, Artificial Sequence
  Synthetic
ccgttttttttttttcctcagag

SEQ ID NO: 14250 - DNA, 23 bp, Artificial Sequence
  Synthetic
ccgttttttttttttaaggaagt

SEQ ID NO: 14251 - DNA, 23 bp, Artificial Sequence
  Synthetic
ccgttttttttttttccagtgcc

SEQ ID NO: 14252 - DNA, 23 bp, Artificial Sequence
  Synthetic
ccgttttttttttttactcttga

SEQ ID NO: 14253 - DNA, 23 bp, Artificial Sequence
  Synthetic
ccgttttttttttttcctgagag

SEQ ID NO: 14254 - DNA, 23 bp, Artificial Sequence
  Synthetic
ccgttttttttttttaaaagtca

SEQ ID NO: 14255 - DNA, 23 bp, Artificial Sequence
  Synthetic
ccgttttttttttttcacaaccc

SEQ ID NO: 14256 - DNA, 23 bp, Artificial Sequence
  Synthetic
ccgttttttttttttcagtagag

SEQ ID NO: 14257 - DNA, 23 bp, Artificial Sequence
  Synthetic
ccgttttttttttttcacatgtt

SEQ ID NO: 14258 - DNA, 23 bp, Artificial Sequence
  Synthetic
ccgttttttttttttaagaggtt

SEQ ID NO: 14259 - DNA, 23 bp, Artificial Sequence
  Synthetic
ccgttttttttttttgaggttga

SEQ ID NO: 14260 - DNA, 23 bp, Artificial Sequence
  Synthetic
ccgttttttttttttctagagag

SEQ ID NO: 14261 - DNA, 23 bp, Artificial Sequence
  Synthetic
ccgttttttttttttccaacgga

SEQ ID NO: 14262 - DNA, 23 bp, Artificial Sequence
  Synthetic
ccgttttttttttttgggaccct

SEQ ID NO: 14263 - DNA, 23 bp, Artificial Sequence
  Synthetic
ccgttttttttttttaactccga

SEQ ID NO: 14264 - DNA, 23 bp, Artificial Sequence
  Synthetic
ccgttttttttttttcgcgcagg

SEQ ID NO: 14265 - DNA, 23 bp, Artificial Sequence
  Synthetic
ccgttttttttttttgctgggcc

SEQ ID NO: 14266 - DNA, 23 bp, Artificial Sequence
  Synthetic
ccgttttttttttttcggtcccg

SEQ ID NO: 14267 - DNA, 23 bp, Artificial Sequence
  Synthetic
ccgttttttttttttagtgggcc

SEQ ID NO: 14268 - DNA, 23 bp, Artificial Sequence
  Synthetic
ccgttttttttttttcctccagc

SEQ ID NO: 14269 - DNA, 23 bp, Artificial Sequence
  Synthetic
ccgttttttttttttaacaaaat

SEQ ID NO: 14270 - DNA, 23 bp, Artificial Sequence
  Synthetic
ccgttttttttttttgttagtgg

SEQ ID NO: 14271 - DNA, 23 bp, Artificial Sequence
  Synthetic
ccgttttttttttttatcacctt

SEQ ID NO: 14272 - DNA, 23 bp, Artificial Sequence
  Synthetic
ccgttttttttttttctgaggct

SEQ ID NO: 14273 - DNA, 23 bp, Artificial Sequence
  Synthetic
ccgttttttttttttgaaaccat

SEQ ID NO: 14274 - DNA, 23 bp, Artificial Sequence
  Synthetic
ccgttttttttttttatgctcag

SEQ ID NO: 14275 - DNA, 23 bp, Artificial Sequence
  Synthetic
ccgttttttttttttcagcagtt

SEQ ID NO: 14276 - DNA, 23 bp, Artificial Sequence
  Synthetic
ccgttttttttttttcactccgt

SEQ ID NO: 14277 - DNA, 23 bp, Artificial Sequence
  Synthetic
ccgttttttttttttaccaagac

SEQ ID NO: 14278 - DNA, 23 bp, Artificial Sequence
  Synthetic
ccgttttttttttttgctcagaa

SEQ ID NO: 14279 - DNA, 23 bp, Artificial Sequence
  Synthetic
ccgttttttttttttgccctgac

SEQ ID NO: 14280 - DNA, 23 bp, Artificial Sequence
  Synthetic
ccgttttttttttttcgattccg

SEQ ID NO: 14281 - DNA, 23 bp, Artificial Sequence
  Synthetic
ccgttttttttttttcaaggatg

SEQ ID NO: 14282 - DNA, 23 bp, Artificial Sequence
  Synthetic
ccgttttttttttttatacagct

SEQ ID NO: 14283 - DNA, 23 bp, Artificial Sequence
  Synthetic
ccgttttttttttttctttcggt

SEQ ID NO: 14284 - DNA, 23 bp, Artificial Sequence
  Synthetic
ccgttttttttttttaggccggg

SEQ ID NO: 14285 - DNA, 23 bp, Artificial Sequence
  Synthetic
ccgttttttttttttaggccggg

SEQ ID NO: 14286 - DNA, 23 bp, Artificial Sequence
  Synthetic
ccgttttttttttttacctgcac

SEQ ID NO: 14287 - DNA, 23 bp, Artificial Sequence
  Synthetic
ccgttttttttttttctcaataa

SEQ ID NO: 14288 - DNA, 23 bp, Artificial Sequence
  Synthetic
ccgttttttttttttcaaaaatg

SEQ ID NO: 14289 - DNA, 23 bp, Artificial Sequence
  Synthetic
ccgttttttttttttacaataca

SEQ ID NO: 14290 - DNA, 23 bp, Artificial Sequence
  Synthetic
ccgttttttttttttacaagatc

SEQ ID NO: 14291 - DNA, 23 bp, Artificial Sequence
  Synthetic
ccgttttttttttttgcaaggtc

SEQ ID NO: 14292 - DNA, 23 bp, Artificial Sequence
  Synthetic
ccgttttttttttttccacttcc

SEQ ID NO: 14293 - DNA, 23 bp, Artificial Sequence
  Synthetic
ccgttttttttttttcttacacc

SEQ ID NO: 14294 - DNA, 23 bp, Artificial Sequence
  Synthetic
ccgttttttttttttccactcgg

SEQ ID NO: 14295 - DNA, 23 bp, Artificial Sequence
  Synthetic
ccgttttttttttttccactcgg

SEQ ID NO: 14296 - DNA, 23 bp, Artificial Sequence
  Synthetic
ccgttttttttttttggacacag

SEQ ID NO: 14297 - DNA, 23 bp, Artificial Sequence
  Synthetic
ccgttttttttttttggagagga

SEQ ID NO: 14298 - DNA, 23 bp, Artificial Sequence
  Synthetic
ccgttttttttttttagatcgac

SEQ ID NO: 14299 - DNA, 23 bp, Artificial Sequence
  Synthetic
ccgttttttttttttgctgccgt

SEQ ID NO: 14300 - DNA, 23 bp, Artificial Sequence
  Synthetic
ccgttttttttttttcacattct

SEQ ID NO: 14301 - DNA, 23 bp, Artificial Sequence
  Synthetic
ccgttttttttttttagctaggc

SEQ ID NO: 14302 - DNA, 23 bp, Artificial Sequence
  Synthetic
ccgttttttttttttctagagta

SEQ ID NO: 14303 - DNA, 23 bp, Artificial Sequence
  Synthetic
ccgttttttttttttcggcaagt

SEQ ID NO: 14304 - DNA, 23 bp, Artificial Sequence
  Synthetic
ccgttttttttttttcaacagcc

SEQ ID NO: 14305 - DNA, 23 bp, Artificial Sequence
  Synthetic
ccgttttttttttttcgatggat

SEQ ID NO: 14306 - DNA, 23 bp, Artificial Sequence
  Synthetic
ccgttttttttttttgcgccagc

SEQ ID NO: 14307 - DNA, 23 bp, Artificial Sequence
  Synthetic
ccgttttttttttttgtgctctc

SEQ ID NO: 14308 - DNA, 23 bp, Artificial Sequence
  Synthetic
ccgttttttttttttcgcagctg

SEQ ID NO: 14309 - DNA, 23 bp, Artificial Sequence
  Synthetic
ccgttttttttttttgcggggtt

SEQ ID NO: 14310 - DNA, 23 bp, Artificial Sequence
  Synthetic
ccgttttttttttttacaagtta

SEQ ID NO: 14311 - DNA, 23 bp, Artificial Sequence
  Synthetic
ccgttttttttttttacaaacca

SEQ ID NO: 14312 - DNA, 23 bp, Artificial Sequence
  Synthetic
ccgttttttttttttaccaatat

SEQ ID NO: 14313 - DNA, 23 bp, Artificial Sequence
  Synthetic
ccgttttttttttttcaagtgcc

SEQ ID NO: 14314 - DNA, 23 bp, Artificial Sequence
  Synthetic
ccgttttttttttttctacctgc

SEQ ID NO: 14315 - DNA, 23 bp, Artificial Sequence
  Synthetic
ccgttttttttttttctgcacta

SEQ ID NO: 14316 - DNA, 23 bp, Artificial Sequence
  Synthetic
ccgttttttttttttagttttgc

SEQ ID NO: 14317 - DNA, 23 bp, Artificial Sequence
  Synthetic
ccgttttttttttttagttttgc

SEQ ID NO: 14318 - DNA, 23 bp, Artificial Sequence
  Synthetic
ccgttttttttttttcctgcact

SEQ ID NO: 14319 - DNA, 23 bp, Artificial Sequence
  Synthetic
ccgttttttttttttacagttgc

SEQ ID NO: 14320 - DNA, 23 bp, Artificial Sequence
  Synthetic
ccgttttttttttttcatggtta

SEQ ID NO: 14321 - DNA, 23 bp, Artificial Sequence
  Synthetic
ccgttttttttttttcagttctt

SEQ ID NO: 14322 - DNA, 23 bp, Artificial Sequence
  Synthetic
ccgttttttttttttgaaatccc

SEQ ID NO: 14323 - DNA, 23 bp, Artificial Sequence
  Synthetic
ccgttttttttttttgcggaact

SEQ ID NO: 14324 - DNA, 23 bp, Artificial Sequence
  Synthetic
ccgttttttttttttcaggccgg

SEQ ID NO: 14325 - DNA, 23 bp, Artificial Sequence
  Synthetic
ccgttttttttttttacaagttc

SEQ ID NO: 14326 - DNA, 23 bp, Artificial Sequence
  Synthetic
ccgttttttttttttcagttatc

SEQ ID NO: 14327 - DNA, 23 bp, Artificial Sequence
  Synthetic
ccgttttttttttttatagccct

SEQ ID NO: 14328 - DNA, 23 bp, Artificial Sequence
  Synthetic
ccgttttttttttttcaggagtc

SEQ ID NO: 14329 - DNA, 23 bp, Artificial Sequence
  Synthetic
ccgttttttttttttctgcactg

SEQ ID NO: 14330 - DNA, 23 bp, Artificial Sequence
  Synthetic
ccgttttttttttttatagccct

SEQ ID NO: 14331 - DNA, 23 bp, Artificial Sequence
  Synthetic
ccgttttttttttttgcattcac

SEQ ID NO: 14332 - DNA, 23 bp, Artificial Sequence
  Synthetic
ccgttttttttttttacaagtta

SEQ ID NO: 14333 - DNA, 23 bp, Artificial Sequence
  Synthetic
ccgttttttttttttgccaagct

SEQ ID NO: 14334 - DNA, 23 bp, Artificial Sequence
  Synthetic
ccgttttttttttttcagctggt

SEQ ID NO: 14335 - DNA, 23 bp, Artificial Sequence
  Synthetic
ccgttttttttttttacatagga

SEQ ID NO: 14336 - DNA, 23 bp, Artificial Sequence
  Synthetic
ccgttttttttttttgacacgtg

SEQ ID NO: 14337 - DNA, 23 bp, Artificial Sequence
  Synthetic
ccgttttttttttttagctacag

SEQ ID NO: 14338 - DNA, 23 bp, Artificial Sequence
  Synthetic
ccgttttttttttttacaaacca

SEQ ID NO: 14339 - DNA, 23 bp, Artificial Sequence
  Synthetic
ccgttttttttttttaaaccatg

SEQ ID NO: 14340 - DNA, 23 bp, Artificial Sequence
  Synthetic
ccgttttttttttttgccaatat

SEQ ID NO: 14341 - DNA, 23 bp, Artificial Sequence
  Synthetic
ccgttttttttttttcaagtgcc

SEQ ID NO: 14342 - DNA, 23 bp, Artificial Sequence
  Synthetic
ccgttttttttttttctacctgc

SEQ ID NO: 14343 - DNA, 23 bp, Artificial Sequence
  Synthetic
ccgttttttttttttctgcacta

SEQ ID NO: 14344 - DNA, 23 bp, Artificial Sequence
  Synthetic
ccgttttttttttttctcaccga

SEQ ID NO: 14345 - DNA, 23 bp, Artificial Sequence
  Synthetic
ccgttttttttttttgtacaatc

SEQ ID NO: 14346 - DNA, 23 bp, Artificial Sequence
  Synthetic
ccgttttttttttttacccaccg

SEQ ID NO: 14347 - DNA, 23 bp, Artificial Sequence
  Synthetic
ccgttttttttttttccaacaac

SEQ ID NO: 14348 - DNA, 23 bp, Artificial Sequence
  Synthetic
ccgttttttttttttctagctcc

SEQ ID NO: 14349 - DNA, 23 bp, Artificial Sequence
  Synthetic
ccgttttttttttttaacaggta

SEQ ID NO: 14350 - DNA, 23 bp, Artificial Sequence
  Synthetic
ccgttttttttttttagttttgc

SEQ ID NO: 14351 - DNA, 23 bp, Artificial Sequence
  Synthetic
ccgttttttttttttagttttgc

SEQ ID NO: 14352 - DNA, 23 bp, Artificial Sequence
  Synthetic
ccgttttttttttttcctgcact

SEQ ID NO: 14353 - DNA, 23 bp, Artificial Sequence
  Synthetic
ccgttttttttttttagactccg

SEQ ID NO: 14354 - DNA, 23 bp, Artificial Sequence
  Synthetic
ccgttttttttttttcatggtta

SEQ ID NO: 14355 - DNA, 23 bp, Artificial Sequence
  Synthetic
ccgttttttttttttcagttctt

SEQ ID NO: 14356 - DNA, 23 bp, Artificial Sequence
  Synthetic
ccgttttttttttttagaccgag

SEQ ID NO: 14357 - DNA, 23 bp, Artificial Sequence
  Synthetic
ccgttttttttttttgcctatcc

SEQ ID NO: 14358 - DNA, 23 bp, Artificial Sequence
  Synthetic
ccgttttttttttttcaatagac

SEQ ID NO: 14359 - DNA, 23 bp, Artificial Sequence
  Synthetic
ccgttttttttttttaccgattt

SEQ ID NO: 14360 - DNA, 23 bp, Artificial Sequence
  Synthetic
ccgttttttttttttctgatttc

SEQ ID NO: 14361 - DNA, 23 bp, Artificial Sequence
  Synthetic
ccgttttttttttttctgagtgt

SEQ ID NO: 14362 - DNA, 23 bp, Artificial Sequence
  Synthetic
ccgttttttttttttctgagagt

SEQ ID NO: 14363 - DNA, 23 bp, Artificial Sequence
  Synthetic
ccgttttttttttttcaaccagc

SEQ ID NO: 14364 - DNA, 23 bp, Artificial Sequence
  Synthetic
ccgttttttttttttacaaaatc

SEQ ID NO: 14365 - DNA, 23 bp, Artificial Sequence
  Synthetic
ccgttttttttttttatacagct

SEQ ID NO: 14366 - DNA, 23 bp, Artificial Sequence
  Synthetic
ccgttttttttttttcaggccgg

SEQ ID NO: 14367 - DNA, 23 bp, Artificial Sequence
  Synthetic
ccgttttttttttttacctgcac

SEQ ID NO: 14368 - DNA, 23 bp, Artificial Sequence
  Synthetic
ccgttttttttttttctcaataa

SEQ ID NO: 14369 - DNA, 23 bp, Artificial Sequence
  Synthetic
ccgttttttttttttacaagatc

SEQ ID NO: 14370 - DNA, 23 bp, Artificial Sequence
  Synthetic
ccgttttttttttttactataca

SEQ ID NO: 14371 - DNA, 23 bp, Artificial Sequence
  Synthetic
ccgttttttttttttaccacaca

SEQ ID NO: 14372 - DNA, 23 bp, Artificial Sequence
  Synthetic
ccgttttttttttttctatgcaa

SEQ ID NO: 14373 - DNA, 23 bp, Artificial Sequence
  Synthetic
ccgttttttttttttactataca

SEQ ID NO: 14374 - DNA, 23 bp, Artificial Sequence
  Synthetic
ccgttttttttttttctgtacaa

SEQ ID NO: 14375 - DNA, 23 bp, Artificial Sequence
  Synthetic
ccgttttttttttttcagcacaa

SEQ ID NO: 14376 - DNA, 23 bp, Artificial Sequence
  Synthetic
ccgttttttttttttcatacttc

SEQ ID NO: 14377 - DNA, 23 bp, Artificial Sequence
  Synthetic
ccgttttttttttttcaagttcg

SEQ ID NO: 14378 - DNA, 23 bp, Artificial Sequence
  Synthetic
ccgttttttttttttcagttatc

SEQ ID NO: 14379 - DNA, 23 bp, Artificial Sequence
  Synthetic
ccgttttttttttttatagccct

SEQ ID NO: 14380 - DNA, 23 bp, Artificial Sequence
  Synthetic
ccgttttttttttttatagccct

SEQ ID NO: 14381 - DNA, 23 bp, Artificial Sequence
  Synthetic
ccgttttttttttttacaaattc

SEQ ID NO: 14382 - DNA, 23 bp, Artificial Sequence
  Synthetic
ccgttttttttttttcaaattcg

SEQ ID NO: 14383 - DNA, 23 bp, Artificial Sequence
  Synthetic
ccgttttttttttttcacaaaca

SEQ ID NO: 14384 - DNA, 23 bp, Artificial Sequence
  Synthetic
ccgttttttttttttgcattcac

SEQ ID NO: 14385 - DNA, 23 bp, Artificial Sequence
  Synthetic
ccgttttttttttttacaagtta

SEQ ID NO: 14386 - DNA, 23 bp, Artificial Sequence
  Synthetic
ccgttttttttttttaagagacc

SEQ ID NO: 14387 - DNA, 23 bp, Artificial Sequence
  Synthetic
ccgttttttttttttgcaagccc

SEQ ID NO: 14388 - DNA, 23 bp, Artificial Sequence
  Synthetic
ccgttttttttttttgccctttt

SEQ ID NO: 14389 - DNA, 23 bp, Artificial Sequence
  Synthetic
ccgttttttttttttgaccatgg

SEQ ID NO: 14390 - DNA, 23 bp, Artificial Sequence
  Synthetic
ccgttttttttttttcagctggt

SEQ ID NO: 14391 - DNA, 23 bp, Artificial Sequence
  Synthetic
ccgttttttttttttacatagga

SEQ ID NO: 14392 - DNA, 23 bp, Artificial Sequence
  Synthetic
ccgttttttttttttacatagga

SEQ ID NO: 14393 - DNA, 23 bp, Artificial Sequence
  Synthetic
ccgttttttttttttacgcgtat

SEQ ID NO: 14394 - DNA, 23 bp, Artificial Sequence
  Synthetic
ccgttttttttttttattcacaa

SEQ ID NO: 14395 - DNA, 23 bp, Artificial Sequence
  Synthetic
ccgttttttttttttcatcttta

SEQ ID NO: 14396 - DNA, 23 bp, Artificial Sequence
  Synthetic
ccgttttttttttttcataaagt

SEQ ID NO: 14397 - DNA, 23 bp, Artificial Sequence
  Synthetic
ccgttttttttttttgagctaca

SEQ ID NO: 14398 - DNA, 23 bp, Artificial Sequence
  Synthetic
ccgttttttttttttcagtacat

SEQ ID NO: 14399 - DNA, 23 bp, Artificial Sequence
  Synthetic
ccgttttttttttttgggattcc

SEQ ID NO: 14400 - DNA, 23 bp, Artificial Sequence
  Synthetic
ccgttttttttttttccaagttc

SEQ ID NO: 14401 - DNA, 23 bp, Artificial Sequence
  Synthetic
ccgttttttttttttacaaacca

SEQ ID NO: 14402 - DNA, 23 bp, Artificial Sequence
  Synthetic
ccgttttttttttttgccaatat

SEQ ID NO: 14403 - DNA, 23 bp, Artificial Sequence
  Synthetic
ccgttttttttttttcaagtgcc

SEQ ID NO: 14404 - DNA, 23 bp, Artificial Sequence
  Synthetic
ccgttttttttttttctacctgc

SEQ ID NO: 14405 - DNA, 23 bp, Artificial Sequence
  Synthetic
ccgttttttttttttctgcacta

SEQ ID NO: 14406 - DNA, 23 bp, Artificial Sequence
  Synthetic
ccgttttttttttttctcaccga

SEQ ID NO: 14407 - DNA, 23 bp, Artificial Sequence
  Synthetic
ccgttttttttttttccaccgac

SEQ ID NO: 14408 - DNA, 23 bp, Artificial Sequence
  Synthetic
ccgttttttttttttctcaccga

SEQ ID NO: 14409 - DNA, 23 bp, Artificial Sequence
  Synthetic
ccgttttttttttttgagttcta

SEQ ID NO: 14410 - DNA, 23 bp, Artificial Sequence
  Synthetic
ccgttttttttttttagtgaatt

SEQ ID NO: 14411 - DNA, 23 bp, Artificial Sequence
  Synthetic
ccgttttttttttttcccttatc

SEQ ID NO: 14412 - DNA, 23 bp, Artificial Sequence
  Synthetic
ccgttttttttttttagcccaaa

SEQ ID NO: 14413 - DNA, 23 bp, Artificial Sequence
  Synthetic
ccgttttttttttttgctgcaac

SEQ ID NO: 14414 - DNA, 23 bp, Artificial Sequence
  Synthetic
ccgttttttttttttgctgcttt

SEQ ID NO: 14415 - DNA, 23 bp, Artificial Sequence
  Synthetic
ccgttttttttttttgggacttt

SEQ ID NO: 14416 - DNA, 23 bp, Artificial Sequence
  Synthetic
ccgttttttttttttcaacaaca

SEQ ID NO: 14417 - DNA, 23 bp, Artificial Sequence
  Synthetic
ccgttttttttttttaacagata

SEQ ID NO: 14418 - DNA, 23 bp, Artificial Sequence
  Synthetic
ccgttttttttttttagttttgc

SEQ ID NO: 14419 - DNA, 23 bp, Artificial Sequence
  Synthetic
ccgttttttttttttagttttgc

SEQ ID NO: 14420 - DNA, 23 bp, Artificial Sequence
  Synthetic
ccgttttttttttttacctgcac

SEQ ID NO: 14421 - DNA, 23 bp, Artificial Sequence
  Synthetic
ccgttttttttttttcatcgtta

SEQ ID NO: 14422 - DNA, 23 bp, Artificial Sequence
  Synthetic
ccgttttttttttttcagcactg

SEQ ID NO: 14423 - DNA, 23 bp, Artificial Sequence
  Synthetic
ccgttttttttttttatcattac

SEQ ID NO: 14424 - DNA, 23 bp, Artificial Sequence
  Synthetic
ccgttttttttttttcatcatta

SEQ ID NO: 14425 - DNA, 23 bp, Artificial Sequence
  Synthetic
ccgttttttttttttaagtggtc

SEQ ID NO: 14426 - DNA, 23 bp, Artificial Sequence
  Synthetic
ccgttttttttttttggcatagg

SEQ ID NO: 14427 - DNA, 23 bp, Artificial Sequence
  Synthetic
ccgttttttttttttacacactt

SEQ ID NO: 14428 - DNA, 23 bp, Artificial Sequence
  Synthetic
ccgttttttttttttcgagcttt

SEQ ID NO: 14429 - DNA, 23 bp, Artificial Sequence
  Synthetic
ccgttttttttttttaacatcag

SEQ ID NO: 14430 - DNA, 23 bp, Artificial Sequence
  Synthetic
ccgttttttttttttgccgtgac

SEQ ID NO: 14431 - DNA, 23 bp, Artificial Sequence
  Synthetic
ccgttttttttttttgcctgtct

SEQ ID NO: 14432 - DNA, 23 bp, Artificial Sequence
  Synthetic
ccgttttttttttttacagttgc

SEQ ID NO: 14433 - DNA, 23 bp, Artificial Sequence
  Synthetic
ccgttttttttttttccaatcag

SEQ ID NO: 14434 - DNA, 23 bp, Artificial Sequence
  Synthetic
ccgttttttttttttcatggtta

SEQ ID NO: 14435 - DNA, 23 bp, Artificial Sequence
  Synthetic
ccgttttttttttttgaattgcg

SEQ ID NO: 14436 - DNA, 23 bp, Artificial Sequence
  Synthetic
ccgttttttttttttcagttctt

SEQ ID NO: 14437 - DNA, 23 bp, Artificial Sequence
  Synthetic
ccgttttttttttttaaacccag

SEQ ID NO: 14438 - DNA, 23 bp, Artificial Sequence
  Synthetic
ccgttttttttttttagacccag

SEQ ID NO: 14439 - DNA, 23 bp, Artificial Sequence
  Synthetic
ccgttttttttttttgggtattt

SEQ ID NO: 14440 - DNA, 23 bp, Artificial Sequence
  Synthetic
ccgttttttttttttaaatccct

SEQ ID NO: 14441 - DNA, 23 bp, Artificial Sequence
  Synthetic
ccgttttttttttttgtaatccc

SEQ ID NO: 14442 - DNA, 23 bp, Artificial Sequence
  Synthetic
ccgttttttttttttgctgaact

SEQ ID NO: 14443 - DNA, 23 bp, Artificial Sequence
  Synthetic
ccgttttttttttttagaccgag

SEQ ID NO: 14444 - DNA, 23 bp, Artificial Sequence
  Synthetic
ccgttttttttttttcggaactt

SEQ ID NO: 14445 - DNA, 23 bp, Artificial Sequence
  Synthetic
ccgttttttttttttcagaactt

SEQ ID NO: 14446 - DNA, 23 bp, Artificial Sequence
  Synthetic
ccgttttttttttttccgatttc

SEQ ID NO: 14447 - DNA, 23 bp, Artificial Sequence
  Synthetic
ccgttttttttttttctgatttc

SEQ ID NO: 14448 - DNA, 23 bp, Artificial Sequence
  Synthetic
ccgttttttttttttaaaacatg

SEQ ID NO: 14449 - DNA, 23 bp, Artificial Sequence
  Synthetic
ccgttttttttttttcaaaacat

SEQ ID NO: 14450 - DNA, 23 bp, Artificial Sequence
  Synthetic
ccgttttttttttttctgaaaca

SEQ ID NO: 14451 - DNA, 23 bp, Artificial Sequence
  Synthetic
ccgttttttttttttctcaaaca

SEQ ID NO: 14452 - DNA, 23 bp, Artificial Sequence
  Synthetic
ccgttttttttttttccagtcga

SEQ ID NO: 14453 - DNA, 23 bp, Artificial Sequence
  Synthetic
ccgttttttttttttagctatgc

SEQ ID NO: 14454 - DNA, 23 bp, Artificial Sequence
  Synthetic
ccgttttttttttttcaacttag

SEQ ID NO: 14455 - DNA, 23 bp, Artificial Sequence
  Synthetic
ccgttttttttttttaacaaaat

SEQ ID NO: 14456 - DNA, 23 bp, Artificial Sequence
  Synthetic
ccgttttttttttttacaaccag

SEQ ID NO: 14457 - DNA, 23 bp, Artificial Sequence
  Synthetic
ccgttttttttttttaaggattt

SEQ ID NO: 14458 - DNA, 23 bp, Artificial Sequence
  Synthetic
ccgttttttttttttaccattgc

SEQ ID NO: 14459 - DNA, 23 bp, Artificial Sequence
  Synthetic
ccgttttttttttttacgcgagc

SEQ ID NO: 14460 - DNA, 23 bp, Artificial Sequence
  Synthetic
ccgttttttttttttgccacaat

SEQ ID NO: 14461 - DNA, 23 bp, Artificial Sequence
  Synthetic
ccgttttttttttttgacggaca

SEQ ID NO: 14462 - DNA, 23 bp, Artificial Sequence
  Synthetic
ccgttttttttttttccagctaa

SEQ ID NO: 14463 - DNA, 23 bp, Artificial Sequence
  Synthetic
ccgttttttttttttacacagta

SEQ ID NO: 14464 - DNA, 23 bp, Artificial Sequence
  Synthetic
ccgttttttttttttaacaaaat

SEQ ID NO: 14465 - DNA, 23 bp, Artificial Sequence
  Synthetic
ccgttttttttttttatacagct

SEQ ID NO: 14466 - DNA, 23 bp, Artificial Sequence
  Synthetic
ccgttttttttttttctttcggt

SEQ ID NO: 14467 - DNA, 23 bp, Artificial Sequence
  Synthetic
ccgttttttttttttaggccggg

SEQ ID NO: 14468 - DNA, 23 bp, Artificial Sequence
  Synthetic
ccgttttttttttttacctgcac

SEQ ID NO: 14469 - DNA, 23 bp, Artificial Sequence
  Synthetic
ccgttttttttttttgcaaaaat

SEQ ID NO: 14470 - DNA, 23 bp, Artificial Sequence
  Synthetic
ccgttttttttttttccgcacag

SEQ ID NO: 14471 - DNA, 23 bp, Artificial Sequence
  Synthetic
ccgttttttttttttggactacc

SEQ ID NO: 14472 - DNA, 23 bp, Artificial Sequence
  Synthetic
ccgttttttttttttagctattc

SEQ ID NO: 14473 - DNA, 23 bp, Artificial Sequence
  Synthetic
ccgttttttttttttcgggagag

SEQ ID NO: 14474 - DNA, 23 bp, Artificial Sequence
  Synthetic
ccgttttttttttttaagggttc

SEQ ID NO: 14475 - DNA, 23 bp, Artificial Sequence
  Synthetic
ccgttttttttttttgtcatgct

SEQ ID NO: 14476 - DNA, 23 bp, Artificial Sequence
  Synthetic
ccgttttttttttttcagtagac

SEQ ID NO: 14477 - DNA, 23 bp, Artificial Sequence
  Synthetic
ccgttttttttttttctgtcatt

SEQ ID NO: 14478 - DNA, 23 bp, Artificial Sequence
  Synthetic
ccgttttttttttttgtaatctc

SEQ ID NO: 14479 - DNA, 23 bp, Artificial Sequence
  Synthetic
ccgttttttttttttctattgtt

SEQ ID NO: 14480 - DNA, 23 bp, Artificial Sequence
  Synthetic
ccgttttttttttttaaggaagt

SEQ ID NO: 14481 - DNA, 23 bp, Artificial Sequence
  Synthetic
ccgttttttttttttaagagggg

SEQ ID NO: 14482 - DNA, 23 bp, Artificial Sequence
  Synthetic
ccgttttttttttttagcgcaac

SEQ ID NO: 14483 - DNA, 23 bp, Artificial Sequence
  Synthetic
ccgttttttttttttgaataaca

SEQ ID NO: 14484 - DNA, 23 bp, Artificial Sequence
  Synthetic
ccgttttttttttttagacgacc

SEQ ID NO: 14485 - DNA, 23 bp, Artificial Sequence
  Synthetic
ccgttttttttttttaaaccacc

SEQ ID NO: 14486 - DNA, 23 bp, Artificial Sequence
  Synthetic
ccgttttttttttttataaaggt

SEQ ID NO: 14487 - DNA, 23 bp, Artificial Sequence
  Synthetic
ccgttttttttttttggttaccg

SEQ ID NO: 14488 - DNA, 23 bp, Artificial Sequence
  Synthetic
ccgttttttttttttaccaaacc

SEQ ID NO: 14489 - DNA, 23 bp, Artificial Sequence
  Synthetic
ccgttttttttttttaaaaggtc

SEQ ID NO: 14490 - DNA, 23 bp, Artificial Sequence
  Synthetic
ccgttttttttttttacaagttc

SEQ ID NO: 14491 - DNA, 23 bp, Artificial Sequence
  Synthetic
ccgttttttttttttcagttatc

SEQ ID NO: 14492 - DNA, 23 bp, Artificial Sequence
  Synthetic
ccgttttttttttttatagccct

SEQ ID NO: 14493 - DNA, 23 bp, Artificial Sequence
  Synthetic
ccgttttttttttttcaggagtc

SEQ ID NO: 14494 - DNA, 23 bp, Artificial Sequence
  Synthetic
ccgttttttttttttctacctgc

SEQ ID NO: 14495 - DNA, 23 bp, Artificial Sequence
  Synthetic
ccgttttttttttttctgcactg

SEQ ID NO: 14496 - DNA, 23 bp, Artificial Sequence
  Synthetic
ccgttttttttttttatagccct

SEQ ID NO: 14497 - DNA, 23 bp, Artificial Sequence
  Synthetic
ccgttttttttttttgcattcac

SEQ ID NO: 14498 - DNA, 23 bp, Artificial Sequence
  Synthetic
ccgttttttttttttacaagtta

SEQ ID NO: 14499 - DNA, 23 bp, Artificial Sequence
  Synthetic
ccgttttttttttttgccaagct

SEQ ID NO: 14500 - DNA, 23 bp, Artificial Sequence
  Synthetic
ccgttttttttttttaaagagac

SEQ ID NO: 14501 - DNA, 23 bp, Artificial Sequence
  Synthetic
ccgttttttttttttccctttta

SEQ ID NO: 14502 - DNA, 23 bp, Artificial Sequence
  Synthetic
ccgttttttttttttcagctggt

SEQ ID NO: 14503 - DNA, 23 bp, Artificial Sequence
  Synthetic
ccgttttttttttttacatagga

SEQ ID NO: 14504 - DNA, 23 bp, Artificial Sequence
  Synthetic
ccgttttttttttttcatcttta

SEQ ID NO: 14505 - DNA, 23 bp, Artificial Sequence
  Synthetic
ccgttttttttttttagggattc

SEQ ID NO: 14506 - DNA, 23 bp, Artificial Sequence
  Synthetic
ccgttttttttttttacttttgt

SEQ ID NO: 14507 - DNA, 23 bp, Artificial Sequence
  Synthetic
ccgttttttttttttacaaacca

SEQ ID NO: 14508 - DNA, 23 bp, Artificial Sequence
  Synthetic
ccgttttttttttttaaaccatg

SEQ ID NO: 14509 - DNA, 23 bp, Artificial Sequence
  Synthetic
ccgttttttttttttgccaatat

SEQ ID NO: 14510 - DNA, 23 bp, Artificial Sequence
  Synthetic
ccgttttttttttttcaagtgcc

SEQ ID NO: 14511 - DNA, 23 bp, Artificial Sequence
  Synthetic
ccgttttttttttttctacctgc

SEQ ID NO: 14512 - DNA, 23 bp, Artificial Sequence
  Synthetic
ccgttttttttttttctgcacta

SEQ ID NO: 14513 - DNA, 23 bp, Artificial Sequence
  Synthetic
ccgttttttttttttctcaccga

SEQ ID NO: 14514 - DNA, 23 bp, Artificial Sequence
  Synthetic
ccgttttttttttttgtacaatc

SEQ ID NO: 14515 - DNA, 23 bp, Artificial Sequence
  Synthetic
ccgttttttttttttacccaccg

SEQ ID NO: 14516 - DNA, 23 bp, Artificial Sequence
  Synthetic
ccgttttttttttttctcaccga

SEQ ID NO: 14517 - DNA, 23 bp, Artificial Sequence
  Synthetic
ccgttttttttttttgagttcta

SEQ ID NO: 14518 - DNA, 23 bp, Artificial Sequence
  Synthetic
ccgttttttttttttagtgaatt

SEQ ID NO: 14519 - DNA, 23 bp, Artificial Sequence
  Synthetic
ccgttttttttttttccctccac

SEQ ID NO: 14520 - DNA, 23 bp, Artificial Sequence
  Synthetic
ccgttttttttttttctgatatc

SEQ ID NO: 14521 - DNA, 23 bp, Artificial Sequence
  Synthetic
ccgttttttttttttcctaatat

SEQ ID NO: 14522 - DNA, 23 bp, Artificial Sequence
  Synthetic
ccgttttttttttttcacatgga

SEQ ID NO: 14523 - DNA, 23 bp, Artificial Sequence
  Synthetic
ccgttttttttttttcaacaaca

SEQ ID NO: 14524 - DNA, 23 bp, Artificial Sequence
  Synthetic
ccgttttttttttttctatttcc

SEQ ID NO: 14525 - DNA, 23 bp, Artificial Sequence
  Synthetic
ccgttttttttttttaacaggta

SEQ ID NO: 14526 - DNA, 23 bp, Artificial Sequence
  Synthetic
ccgttttttttttttagttttgc

SEQ ID NO: 14527 - DNA, 23 bp, Artificial Sequence
  Synthetic
ccgttttttttttttagttttgc

SEQ ID NO: 14528 - DNA, 23 bp, Artificial Sequence
  Synthetic
ccgttttttttttttcctgcact

SEQ ID NO: 14529 - DNA, 23 bp, Artificial Sequence
  Synthetic
ccgttttttttttttcatcatta

SEQ ID NO: 14530 - DNA, 23 bp, Artificial Sequence
  Synthetic
ccgttttttttttttaacatcag

SEQ ID NO: 14531 - DNA, 23 bp, Artificial Sequence
  Synthetic
ccgttttttttttttggcaaagg

SEQ ID NO: 14532 - DNA, 23 bp, Artificial Sequence
  Synthetic
ccgttttttttttttgcctgtct

SEQ ID NO: 14533 - DNA, 23 bp, Artificial Sequence
  Synthetic
ccgttttttttttttctgtcaat

SEQ ID NO: 14534 - DNA, 23 bp, Artificial Sequence
  Synthetic
ccgttttttttttttcatggtta

SEQ ID NO: 14535 - DNA, 23 bp, Artificial Sequence
  Synthetic
ccgttttttttttttgaattgcg

SEQ ID NO: 14536 - DNA, 23 bp, Artificial Sequence
  Synthetic
ccgttttttttttttcagttctt

SEQ ID NO: 14537 - DNA, 23 bp, Artificial Sequence
  Synthetic
ccgttttttttttttaagtgtca

SEQ ID NO: 14538 - DNA, 23 bp, Artificial Sequence
  Synthetic
ccgttttttttttttaaacccag

SEQ ID NO: 14539 - DNA, 23 bp, Artificial Sequence
  Synthetic
ccgttttttttttttgggtattt

SEQ ID NO: 14540 - DNA, 23 bp, Artificial Sequence
  Synthetic
ccgttttttttttttaacggaac

SEQ ID NO: 14541 - DNA, 23 bp, Artificial Sequence
  Synthetic
ccgttttttttttttgaaatccc

SEQ ID NO: 14542 - DNA, 23 bp, Artificial Sequence
  Synthetic
ccgttttttttttttgttcctgc

SEQ ID NO: 14543 - DNA, 23 bp, Artificial Sequence
  Synthetic
ccgttttttttttttagaccgag

SEQ ID NO: 14544 - DNA, 23 bp, Artificial Sequence
  Synthetic
ccgttttttttttttgcctatcc

SEQ ID NO: 14545 - DNA, 23 bp, Artificial Sequence
  Synthetic
ccgttttttttttttgcggaact

SEQ ID NO: 14546 - DNA, 23 bp, Artificial Sequence
  Synthetic
ccgttttttttttttcaatagac

SEQ ID NO: 14547 - DNA, 23 bp, Artificial Sequence
  Synthetic
ccgttttttttttttaccgattt

SEQ ID NO: 14548 - DNA, 23 bp, Artificial Sequence
  Synthetic
ccgttttttttttttctgcaaac

SEQ ID NO: 14549 - DNA, 23 bp, Artificial Sequence
  Synthetic
ccgttttttttttttccagtcga

SEQ ID NO: 14550 - DNA, 23 bp, Artificial Sequence
  Synthetic
ccgttttttttttttctgagtgt

SEQ ID NO: 14551 - DNA, 23 bp, Artificial Sequence
  Synthetic
ccgttttttttttttagctatgc

SEQ ID NO: 14552 - DNA, 23 bp, Artificial Sequence
  Synthetic
ccgttttttttttttcaacttag

SEQ ID NO: 14553 - DNA, 23 bp, Artificial Sequence
  Synthetic
ccgttttttttttttaatgcaac

SEQ ID NO: 14554 - DNA, 23 bp, Artificial Sequence
  Synthetic
ccgttttttttttttcaaccagc

SEQ ID NO: 14555 - DNA, 23 bp, Artificial Sequence
  Synthetic
ccgttttttttttttcaggccgg

SEQ ID NO: 14556 - DNA, 23 bp, Artificial Sequence
  Synthetic
ccgttttttttttttacctgcac

SEQ ID NO: 14557 - DNA, 23 bp, Artificial Sequence
  Synthetic
ccgttttttttttttcaaaaatg

SEQ ID NO: 14558 - DNA, 23 bp, Artificial Sequence
  Synthetic
ccgttttttttttttacaataca

SEQ ID NO: 14559 - DNA, 23 bp, Artificial Sequence
  Synthetic
ccgttttttttttttacaagatc

SEQ ID NO: 14560 - DNA, 23 bp, Artificial Sequence
  Synthetic
ccgttttttttttttctatacaa

SEQ ID NO: 14561 - DNA, 23 bp, Artificial Sequence
  Synthetic
ccgttttttttttttaccacaca

SEQ ID NO: 14562 - DNA, 23 bp, Artificial Sequence
  Synthetic
ccgttttttttttttaccataca

SEQ ID NO: 14563 - DNA, 23 bp, Artificial Sequence
  Synthetic
ccgttttttttttttctatgcaa

SEQ ID NO: 14564 - DNA, 23 bp, Artificial Sequence
  Synthetic
ccgttttttttttttgaaaggca

SEQ ID NO: 14565 - DNA, 23 bp, Artificial Sequence
  Synthetic
ccgttttttttttttctatacaa

SEQ ID NO: 14566 - DNA, 23 bp, Artificial Sequence
  Synthetic
ccgttttttttttttctatacaa

SEQ ID NO: 14567 - DNA, 23 bp, Artificial Sequence
  Synthetic
ccgttttttttttttctgtacaa

SEQ ID NO: 14568 - DNA, 23 bp, Artificial Sequence
  Synthetic
ccgttttttttttttcagcacaa

SEQ ID NO: 14569 - DNA, 23 bp, Artificial Sequence
  Synthetic
ccgttttttttttttcatacttc

SEQ ID NO: 14570 - DNA, 23 bp, Artificial Sequence
  Synthetic
ccgttttttttttttacaagttc

SEQ ID NO: 14571 - DNA, 23 bp, Artificial Sequence
  Synthetic
ccgttttttttttttcagttatc

SEQ ID NO: 14572 - DNA, 23 bp, Artificial Sequence
  Synthetic
ccgttttttttttttcagctatc

SEQ ID NO: 14573 - DNA, 23 bp, Artificial Sequence
  Synthetic
ccgttttttttttttatagccct

SEQ ID NO: 14574 - DNA, 23 bp, Artificial Sequence
  Synthetic
ccgttttttttttttcctgcact

SEQ ID NO: 14575 - DNA, 23 bp, Artificial Sequence
  Synthetic
ccgttttttttttttctgcactg

SEQ ID NO: 14576 - DNA, 23 bp, Artificial Sequence
  Synthetic
ccgttttttttttttatagccct

SEQ ID NO: 14577 - DNA, 23 bp, Artificial Sequence
  Synthetic
ccgttttttttttttacaaattc

SEQ ID NO: 14578 - DNA, 23 bp, Artificial Sequence
  Synthetic
ccgttttttttttttcacaaatt

SEQ ID NO: 14579 - DNA, 23 bp, Artificial Sequence
  Synthetic
ccgttttttttttttcaaacacc

SEQ ID NO: 14580 - DNA, 23 bp, Artificial Sequence
  Synthetic
ccgttttttttttttgcattcac

SEQ ID NO: 14581 - DNA, 23 bp, Artificial Sequence
  Synthetic
ccgttttttttttttacaggtta

SEQ ID NO: 14582 - DNA, 23 bp, Artificial Sequence
  Synthetic
ccgttttttttttttacaagtta

SEQ ID NO: 14583 - DNA, 23 bp, Artificial Sequence
  Synthetic
ccgttttttttttttcattatta

SEQ ID NO: 14584 - DNA, 23 bp, Artificial Sequence
  Synthetic
ccgttttttttttttgcgtacca

SEQ ID NO: 14585 - DNA, 23 bp, Artificial Sequence
  Synthetic
ccgttttttttttttccaagctc

SEQ ID NO: 14586 - DNA, 23 bp, Artificial Sequence
  Synthetic
ccgttttttttttttaaagagac

SEQ ID NO: 14587 - DNA, 23 bp, Artificial Sequence
  Synthetic
ccgttttttttttttaaagagac

SEQ ID NO: 14588 - DNA, 23 bp, Artificial Sequence
  Synthetic
ccgttttttttttttgctttttg

SEQ ID NO: 14589 - DNA, 23 bp, Artificial Sequence
  Synthetic
ccgttttttttttttgcaagccc

SEQ ID NO: 14590 - DNA, 23 bp, Artificial Sequence
  Synthetic
ccgttttttttttttgccctttt

SEQ ID NO: 14591 - DNA, 23 bp, Artificial Sequence
  Synthetic
ccgttttttttttttgccctttc

SEQ ID NO: 14592 - DNA, 23 bp, Artificial Sequence
  Synthetic
ccgttttttttttttgaccatgg

SEQ ID NO: 14593 - DNA, 23 bp, Artificial Sequence
  Synthetic
ccgttttttttttttcagctggt

SEQ ID NO: 14594 - DNA, 23 bp, Artificial Sequence
  Synthetic
ccgttttttttttttggttccat

SEQ ID NO: 14595 - DNA, 23 bp, Artificial Sequence
  Synthetic
ccgttttttttttttgctggttg

SEQ ID NO: 14596 - DNA, 23 bp, Artificial Sequence
  Synthetic
ccgttttttttttttccctctgg

SEQ ID NO: 14597 - DNA, 23 bp, Artificial Sequence
  Synthetic
ccgttttttttttttacatagga

SEQ ID NO: 14598 - DNA, 23 bp, Artificial Sequence
  Synthetic
ccgttttttttttttacatagga

SEQ ID NO: 14599 - DNA, 23 bp, Artificial Sequence
  Synthetic
ccgttttttttttttcatcatca

SEQ ID NO: 14600 - DNA, 23 bp, Artificial Sequence
  Synthetic
ccgttttttttttttacgcgtat

SEQ ID NO: 14601 - DNA, 23 bp, Artificial Sequence
  Synthetic
ccgttttttttttttattcacaa

SEQ ID NO: 14602 - DNA, 23 bp, Artificial Sequence
  Synthetic
ccgttttttttttttgacacgtg

SEQ ID NO: 14603 - DNA, 23 bp, Artificial Sequence
  Synthetic
ccgttttttttttttaccatagg

SEQ ID NO: 14604 - DNA, 23 bp, Artificial Sequence
  Synthetic
ccgttttttttttttcgtggttc

SEQ ID NO: 14605 - DNA, 23 bp, Artificial Sequence
  Synthetic
ccgttttttttttttcatcttta

SEQ ID NO: 14606 - DNA, 23 bp, Artificial Sequence
  Synthetic
ccgttttttttttttcataaagt

SEQ ID NO: 14607 - DNA, 23 bp, Artificial Sequence
  Synthetic
ccgttttttttttttagtgcttt

SEQ ID NO: 14608 - DNA, 23 bp, Artificial Sequence
  Synthetic
ccgttttttttttttagctacag

SEQ ID NO: 14609 - DNA, 23 bp, Artificial Sequence
  Synthetic
ccgttttttttttttagtacatc

SEQ ID NO: 14610 - DNA, 23 bp, Artificial Sequence
  Synthetic
ccgttttttttttttagggattc

SEQ ID NO: 14611 - DNA, 23 bp, Artificial Sequence
  Synthetic
ccgttttttttttttacccatgg

SEQ ID NO: 14612 - DNA, 23 bp, Artificial Sequence
  Synthetic
ccgttttttttttttgcctatgg

SEQ ID NO: 14613 - DNA, 23 bp, Artificial Sequence
  Synthetic
ccgttttttttttttcaaagttc

SEQ ID NO: 14614 - DNA, 23 bp, Artificial Sequence
  Synthetic
ccgttttttttttttcaaagttc

SEQ ID NO: 14615 - DNA, 23 bp, Artificial Sequence
  Synthetic
ccgttttttttttttgagtgaag

SEQ ID NO: 14616 - DNA, 23 bp, Artificial Sequence
  Synthetic
ccgttttttttttttactggtac

SEQ ID NO: 14617 - DNA, 23 bp, Artificial Sequence
  Synthetic
ccgttttttttttttctcaagga

SEQ ID NO: 14618 - DNA, 23 bp, Artificial Sequence
  Synthetic
ccgttttttttttttccaagttc

SEQ ID NO: 14619 - DNA, 23 bp, Artificial Sequence
  Synthetic
ccgttttttttttttatcacttt

SEQ ID NO: 14620 - DNA, 23 bp, Artificial Sequence
  Synthetic
ccgttttttttttttgaaggcaa

SEQ ID NO: 14621 - DNA, 23 bp, Artificial Sequence
  Synthetic
ccgttttttttttttccctatca

SEQ ID NO: 14622 - DNA, 23 bp, Artificial Sequence
  Synthetic
ccgttttttttttttacaaacca

SEQ ID NO: 14623 - DNA, 23 bp, Artificial Sequence
  Synthetic
ccgttttttttttttaaaccatg

SEQ ID NO: 14624 - DNA, 23 bp, Artificial Sequence
  Synthetic
ccgttttttttttttgccaatat

SEQ ID NO: 14625 - DNA, 23 bp, Artificial Sequence
  Synthetic
ccgttttttttttttcaagtgcc

SEQ ID NO: 14626 - DNA, 23 bp, Artificial Sequence
  Synthetic
ccgttttttttttttctacctgc

SEQ ID NO: 14627 - DNA, 23 bp, Artificial Sequence
  Synthetic
ccgttttttttttttctgcacta

SEQ ID NO: 14628 - DNA, 23 bp, Artificial Sequence
  Synthetic
ccgttttttttttttctcaccga

SEQ ID NO: 14629 - DNA, 23 bp, Artificial Sequence
  Synthetic
ccgttttttttttttgtacaatc

SEQ ID NO: 14630 - DNA, 23 bp, Artificial Sequence
  Synthetic
ccgttttttttttttccaccgac

SEQ ID NO: 14631 - DNA, 23 bp, Artificial Sequence
  Synthetic
ccgttttttttttttctcaccga

SEQ ID NO: 14632 - DNA, 23 bp, Artificial Sequence
  Synthetic
ccgttttttttttttgagttcta

SEQ ID NO: 14633 - DNA, 23 bp, Artificial Sequence
  Synthetic
ccgttttttttttttagtgaatt

SEQ ID NO: 14634 - DNA, 23 bp, Artificial Sequence
  Synthetic
ccgttttttttttttcccttatc

SEQ ID NO: 14635 - DNA, 23 bp, Artificial Sequence
  Synthetic
ccgttttttttttttaactgcct

SEQ ID NO: 14636 - DNA, 23 bp, Artificial Sequence
  Synthetic
ccgttttttttttttagcccaaa

SEQ ID NO: 14637 - DNA, 23 bp, Artificial Sequence
  Synthetic
ccgttttttttttttcggctgca

SEQ ID NO: 14638 - DNA, 23 bp, Artificial Sequence
  Synthetic
ccgttttttttttttccctccac

SEQ ID NO: 14639 - DNA, 23 bp, Artificial Sequence
  Synthetic
ccgttttttttttttctgatatc

SEQ ID NO: 14640 - DNA, 23 bp, Artificial Sequence
  Synthetic
ccgttttttttttttcctaatat

SEQ ID NO: 14641 - DNA, 23 bp, Artificial Sequence
  Synthetic
ccgttttttttttttgctgcttt

SEQ ID NO: 14642 - DNA, 23 bp, Artificial Sequence
  Synthetic
ccgttttttttttttcaattcat

SEQ ID NO: 14643 - DNA, 23 bp, Artificial Sequence
  Synthetic
ccgttttttttttttgggacttt

SEQ ID NO: 14644 - DNA, 23 bp, Artificial Sequence
  Synthetic
ccgttttttttttttcacatgga

SEQ ID NO: 14645 - DNA, 23 bp, Artificial Sequence
  Synthetic
ccgttttttttttttccaatatt

SEQ ID NO: 14646 - DNA, 23 bp, Artificial Sequence
  Synthetic
ccgttttttttttttcaacaaca

SEQ ID NO: 14647 - DNA, 23 bp, Artificial Sequence
  Synthetic
ccgttttttttttttcaacaaca

SEQ ID NO: 14648 - DNA, 23 bp, Artificial Sequence
  Synthetic
ccgttttttttttttaacaggta

SEQ ID NO: 14649 - DNA, 23 bp, Artificial Sequence
  Synthetic
ccgttttttttttttaccaatgt

SEQ ID NO: 14650 - DNA, 23 bp, Artificial Sequence
  Synthetic
ccgttttttttttttaacaggta

SEQ ID NO: 14651 - DNA, 23 bp, Artificial Sequence
  Synthetic
ccgttttttttttttagttttgc

SEQ ID NO: 14652 - DNA, 23 bp, Artificial Sequence
  Synthetic
ccgttttttttttttagttttgc

SEQ ID NO: 14653 - DNA, 23 bp, Artificial Sequence
  Synthetic
ccgttttttttttttcatcgtta

SEQ ID NO: 14654 - DNA, 23 bp, Artificial Sequence
  Synthetic
ccgttttttttttttcatcatta

SEQ ID NO: 14655 - DNA, 23 bp, Artificial Sequence
  Synthetic
ccgttttttttttttcatcatta

SEQ ID NO: 14656 - DNA, 23 bp, Artificial Sequence
  Synthetic
ccgttttttttttttgaacaatg

SEQ ID NO: 14657 - DNA, 23 bp, Artificial Sequence
  Synthetic
ccgttttttttttttcccatgcg

SEQ ID NO: 14658 - DNA, 23 bp, Artificial Sequence
  Synthetic
ccgttttttttttttagtggtcc

SEQ ID NO: 14659 - DNA, 23 bp, Artificial Sequence
  Synthetic
ccgttttttttttttaggcatag

SEQ ID NO: 14660 - DNA, 23 bp, Artificial Sequence
  Synthetic
ccgttttttttttttagactccg

SEQ ID NO: 14661 - DNA, 23 bp, Artificial Sequence
  Synthetic
ccgttttttttttttcacacact

SEQ ID NO: 14662 - DNA, 23 bp, Artificial Sequence
  Synthetic
ccgttttttttttttagggagga

SEQ ID NO: 14663 - DNA, 23 bp, Artificial Sequence
  Synthetic
ccgttttttttttttcaagcttt

SEQ ID NO: 14664 - DNA, 23 bp, Artificial Sequence
  Synthetic
ccgttttttttttttacctgcac

SEQ ID NO: 14665 - DNA, 23 bp, Artificial Sequence
  Synthetic
ccgttttttttttttcctgcact

SEQ ID NO: 14666 - DNA, 23 bp, Artificial Sequence
  Synthetic
ccgttttttttttttaacatcag

SEQ ID NO: 14667 - DNA, 23 bp, Artificial Sequence
  Synthetic
ccgttttttttttttagccgctg

SEQ ID NO: 14668 - DNA, 23 bp, Artificial Sequence
  Synthetic
ccgttttttttttttggcaaagg

SEQ ID NO: 14669 - DNA, 23 bp, Artificial Sequence
  Synthetic
ccgttttttttttttgccgtgac

SEQ ID NO: 14670 - DNA, 23 bp, Artificial Sequence
  Synthetic
ccgttttttttttttgcctgtct

SEQ ID NO: 14671 - DNA, 23 bp, Artificial Sequence
  Synthetic
ccgttttttttttttctgtcaaa

SEQ ID NO: 14672 - DNA, 23 bp, Artificial Sequence
  Synthetic
ccgttttttttttttacagttgc

SEQ ID NO: 14673 - DNA, 23 bp, Artificial Sequence
  Synthetic
ccgttttttttttttacatttgc

SEQ ID NO: 14674 - DNA, 23 bp, Artificial Sequence
  Synthetic
ccgttttttttttttccagtcag

SEQ ID NO: 14675 - DNA, 23 bp, Artificial Sequence
  Synthetic
ccgttttttttttttcatggtta

SEQ ID NO: 14676 - DNA, 23 bp, Artificial Sequence
  Synthetic
ccgttttttttttttgaattgcg

SEQ ID NO: 14677 - DNA, 23 bp, Artificial Sequence
  Synthetic
ccgttttttttttttcagttctt

SEQ ID NO: 14678 - DNA, 23 bp, Artificial Sequence
  Synthetic
ccgttttttttttttaacccagc

SEQ ID NO: 14679 - DNA, 23 bp, Artificial Sequence
  Synthetic
ccgttttttttttttagacccag

SEQ ID NO: 14680 - DNA, 23 bp, Artificial Sequence
  Synthetic
ccgttttttttttttgggtattt

SEQ ID NO: 14681 - DNA, 23 bp, Artificial Sequence
  Synthetic
ccgttttttttttttaacggaac

SEQ ID NO: 14682 - DNA, 23 bp, Artificial Sequence
  Synthetic
ccgttttttttttttgaaatccc

SEQ ID NO: 14683 - DNA, 23 bp, Artificial Sequence
  Synthetic
ccgttttttttttttgtaatccc

SEQ ID NO: 14684 - DNA, 23 bp, Artificial Sequence
  Synthetic
ccgttttttttttttgttcctgc

SEQ ID NO: 14685 - DNA, 23 bp, Artificial Sequence
  Synthetic
ccgttttttttttttagaccgag

SEQ ID NO: 14686 - DNA, 23 bp, Artificial Sequence
  Synthetic
ccgttttttttttttcctatcct

SEQ ID NO: 14687 - DNA, 23 bp, Artificial Sequence
  Synthetic
ccgttttttttttttacctatcc

SEQ ID NO: 14688 - DNA, 23 bp, Artificial Sequence
  Synthetic
ccgttttttttttttcggaactt

SEQ ID NO: 14689 - DNA, 23 bp, Artificial Sequence
  Synthetic
ccgttttttttttttcagaactt

SEQ ID NO: 14690 - DNA, 23 bp, Artificial Sequence
  Synthetic
ccgttttttttttttcaatagac

SEQ ID NO: 14691 - DNA, 23 bp, Artificial Sequence
  Synthetic
ccgttttttttttttaaaagtgc

SEQ ID NO: 14692 - DNA, 23 bp, Artificial Sequence
  Synthetic
ccgttttttttttttgcacacaa

SEQ ID NO: 14693 - DNA, 23 bp, Artificial Sequence
  Synthetic
ccgttttttttttttgagagggc

SEQ ID NO: 14694 - DNA, 23 bp, Artificial Sequence
  Synthetic
ccgttttttttttttacaaacaa

SEQ ID NO: 14695 - DNA, 23 bp, Artificial Sequence
  Synthetic
ccgttttttttttttagagggcc

SEQ ID NO: 14696 - DNA, 23 bp, Artificial Sequence
  Synthetic
ccgttttttttttttcactcaaa

SEQ ID NO: 14697 - DNA, 23 bp, Artificial Sequence
  Synthetic
ccgttttttttttttaaaagagc

SEQ ID NO: 14698 - DNA, 23 bp, Artificial Sequence
  Synthetic
ccgttttttttttttcactacaa

SEQ ID NO: 14699 - DNA, 23 bp, Artificial Sequence
  Synthetic
ccgttttttttttttcacacaaa

SEQ ID NO: 14700 - DNA, 23 bp, Artificial Sequence
  Synthetic
ccgttttttttttttgactcaaa

SEQ ID NO: 14701 - DNA, 23 bp, Artificial Sequence
  Synthetic
ccgttttttttttttcaggattg

SEQ ID NO: 14702 - DNA, 23 bp, Artificial Sequence
  Synthetic
ccgttttttttttttatgcacat

SEQ ID NO: 14703 - DNA, 23 bp, Artificial Sequence
  Synthetic
ccgttttttttttttcatgttca

SEQ ID NO: 14704 - DNA, 23 bp, Artificial Sequence
  Synthetic
ccgttttttttttttgaagaaca

SEQ ID NO: 14705 - DNA, 23 bp, Artificial Sequence
  Synthetic
ccgttttttttttttgtatgtgg

SEQ ID NO: 14706 - DNA, 23 bp, Artificial Sequence
  Synthetic
ccgttttttttttttaccgattt

SEQ ID NO: 14707 - DNA, 23 bp, Artificial Sequence
  Synthetic
ccgttttttttttttacactgat

SEQ ID NO: 14708 - DNA, 23 bp, Artificial Sequence
  Synthetic
ccgttttttttttttccgatttc

SEQ ID NO: 14709 - DNA, 23 bp, Artificial Sequence
  Synthetic
ccgttttttttttttaagagagc

SEQ ID NO: 14710 - DNA, 23 bp, Artificial Sequence
  Synthetic
ccgttttttttttttctttgaca

SEQ ID NO: 14711 - DNA, 23 bp, Artificial Sequence
  Synthetic
ccgttttttttttttctttgaca

SEQ ID NO: 14712 - DNA, 23 bp, Artificial Sequence
  Synthetic
ccgttttttttttttaccaaaac

SEQ ID NO: 14713 - DNA, 23 bp, Artificial Sequence
  Synthetic
ccgttttttttttttactaaaac

SEQ ID NO: 14714 - DNA, 23 bp, Artificial Sequence
  Synthetic
ccgttttttttttttgaaagcat

SEQ ID NO: 14715 - DNA, 23 bp, Artificial Sequence
  Synthetic
ccgttttttttttttcactgaaa

SEQ ID NO: 14716 - DNA, 23 bp, Artificial Sequence
  Synthetic
ccgttttttttttttagcaggta

SEQ ID NO: 14717 - DNA, 23 bp, Artificial Sequence
  Synthetic
ccgttttttttttttcactcaaa

SEQ ID NO: 14718 - DNA, 23 bp, Artificial Sequence
  Synthetic
ccgttttttttttttctgcaaac

SEQ ID NO: 14719 - DNA, 23 bp, Artificial Sequence
  Synthetic
ccgttttttttttttccagtcga

SEQ ID NO: 14720 - DNA, 23 bp, Artificial Sequence
  Synthetic
ccgttttttttttttgctgagtg

SEQ ID NO: 14721 - DNA, 23 bp, Artificial Sequence
  Synthetic
ccgttttttttttttctgagagt

SEQ ID NO: 14722 - DNA, 23 bp, Artificial Sequence
  Synthetic
ccgttttttttttttccagtcgg

SEQ ID NO: 14723 - DNA, 23 bp, Artificial Sequence
  Synthetic
ccgttttttttttttcagtcaag

SEQ ID NO: 14724 - DNA, 23 bp, Artificial Sequence
  Synthetic
ccgttttttttttttgtaaacat

SEQ ID NO: 14725 - DNA, 23 bp, Artificial Sequence
  Synthetic
ccgttttttttttttagctatgc

SEQ ID NO: 14726 - DNA, 23 bp, Artificial Sequence
  Synthetic
ccgttttttttttttcaacttag

SEQ ID NO: 14727 - DNA, 23 bp, Artificial Sequence
  Synthetic
ccgttttttttttttgccctctc

SEQ ID NO: 14728 - DNA, 23 bp, Artificial Sequence
  Synthetic
ccgttttttttttttgcagcgct

SEQ ID NO: 14729 - DNA, 23 bp, Artificial Sequence
  Synthetic
ccgttttttttttttgaggtcga

SEQ ID NO: 14730 - DNA, 23 bp, Artificial Sequence
  Synthetic
ccgttttttttttttcagcagca

SEQ ID NO: 14731 - DNA, 23 bp, Artificial Sequence
  Synthetic
ccgttttttttttttaccaatgc

SEQ ID NO: 14732 - DNA, 23 bp, Artificial Sequence
  Synthetic
ccgttttttttttttcacttact

SEQ ID NO: 14733 - DNA, 23 bp, Artificial Sequence
  Synthetic
ccgttttttttttttctggagga

SEQ ID NO: 14734 - DNA, 23 bp, Artificial Sequence
  Synthetic
ccgttttttttttttcggaaggg

SEQ ID NO: 14735 - DNA, 23 bp, Artificial Sequence
  Synthetic
ccgttttttttttttaaaaggtt

SEQ ID NO: 14736 - DNA, 23 bp, Artificial Sequence
  Synthetic
ccgttttttttttttaatgcaac

SEQ ID NO: 14737 - DNA, 23 bp, Artificial Sequence
  Synthetic
ccgttttttttttttctgcaggc

SEQ ID NO: 14738 - DNA, 23 bp, Artificial Sequence
  Synthetic
ccgttttttttttttaggatagg

SEQ ID NO: 14739 - DNA, 23 bp, Artificial Sequence
  Synthetic
ccgttttttttttttcatttttc

SEQ ID NO: 14740 - DNA, 23 bp, Artificial Sequence
  Synthetic
ccgttttttttttttaaggcatc

SEQ ID NO: 14741 - DNA, 23 bp, Artificial Sequence
  Synthetic
ccgttttttttttttaacaaaat

SEQ ID NO: 14742 - DNA, 23 bp, Artificial Sequence
  Synthetic
ccgttttttttttttagctcctg

SEQ ID NO: 14743 - DNA, 23 bp, Artificial Sequence
  Synthetic
ccgttttttttttttgctataaa

SEQ ID NO: 14744 - DNA, 23 bp, Artificial Sequence
  Synthetic
ccgttttttttttttctgaccga

SEQ ID NO: 14745 - DNA, 23 bp, Artificial Sequence
  Synthetic
ccgttttttttttttacgggtgc

SEQ ID NO: 14746 - DNA, 23 bp, Artificial Sequence
  Synthetic
ccgttttttttttttcagtcagg

SEQ ID NO: 14747 - DNA, 23 bp, Artificial Sequence
  Synthetic
ccgttttttttttttcactggac

SEQ ID NO: 14748 - DNA, 23 bp, Artificial Sequence
  Synthetic
ccgttttttttttttgaggcagg

SEQ ID NO: 14749 - DNA, 23 bp, Artificial Sequence
  Synthetic
ccgttttttttttttacaaccag

SEQ ID NO: 14750 - DNA, 23 bp, Artificial Sequence
  Synthetic
ccgttttttttttttaatcagct

SEQ ID NO: 14751 - DNA, 23 bp, Artificial Sequence
  Synthetic
ccgttttttttttttcaatcagc

SEQ ID NO: 14752 - DNA, 23 bp, Artificial Sequence
  Synthetic
ccgttttttttttttaaagtgta

SEQ ID NO: 14753 - DNA, 23 bp, Artificial Sequence
  Synthetic
ccgttttttttttttaggctcaa

SEQ ID NO: 14754 - DNA, 23 bp, Artificial Sequence
  Synthetic
ccgttttttttttttacccctgg

SEQ ID NO: 14755 - DNA, 23 bp, Artificial Sequence
  Synthetic
ccgttttttttttttacacctag

SEQ ID NO: 14756 - DNA, 23 bp, Artificial Sequence
  Synthetic
ccgttttttttttttcagatgga

SEQ ID NO: 14757 - DNA, 23 bp, Artificial Sequence
  Synthetic
ccgttttttttttttaaggattt

SEQ ID NO: 14758 - DNA, 23 bp, Artificial Sequence
  Synthetic
ccgttttttttttttaccattgc

SEQ ID NO: 14759 - DNA, 23 bp, Artificial Sequence
  Synthetic
ccgttttttttttttagatcaac

SEQ ID NO: 14760 - DNA, 23 bp, Artificial Sequence
  Synthetic
ccgttttttttttttgaatataa

SEQ ID NO: 14761 - DNA, 23 bp, Artificial Sequence
  Synthetic
ccgttttttttttttaccaggtt

SEQ ID NO: 14762 - DNA, 23 bp, Artificial Sequence
  Synthetic
ccgttttttttttttcggacaat

SEQ ID NO: 14763 - DNA, 23 bp, Artificial Sequence
  Synthetic
ccgttttttttttttacttagca

SEQ ID NO: 14764 - DNA, 23 bp, Artificial Sequence
  Synthetic
ccgttttttttttttacgcgagc

SEQ ID NO: 14765 - DNA, 23 bp, Artificial Sequence
  Synthetic
ccgttttttttttttcgtggatt

SEQ ID NO: 14766 - DNA, 23 bp, Artificial Sequence
  Synthetic
ccgttttttttttttcatagaag

SEQ ID NO: 14767 - DNA, 23 bp, Artificial Sequence
  Synthetic
ccgttttttttttttaagtggat

SEQ ID NO: 14768 - DNA, 23 bp, Artificial Sequence
  Synthetic
ccgttttttttttttaccataga

SEQ ID NO: 14769 - DNA, 23 bp, Artificial Sequence
  Synthetic
ccgttttttttttttgtgaaatt

SEQ ID NO: 14770 - DNA, 23 bp, Artificial Sequence
  Synthetic
ccgttttttttttttcaaaagtt

SEQ ID NO: 14771 - DNA, 23 bp, Artificial Sequence
  Synthetic
ccgttttttttttttcacaggac

SEQ ID NO: 14772 - DNA, 23 bp, Artificial Sequence
  Synthetic
ccgttttttttttttctacgttc

SEQ ID NO: 14773 - DNA, 23 bp, Artificial Sequence
  Synthetic
ccgttttttttttttagatgtgg

SEQ ID NO: 14774 - DNA, 23 bp, Artificial Sequence
  Synthetic
ccgttttttttttttcgcatgtt

SEQ ID NO: 14775 - DNA, 23 bp, Artificial Sequence
  Synthetic
ccgttttttttttttcagagagc

SEQ ID NO: 14776 - DNA, 23 bp, Artificial Sequence
  Synthetic
ccgttttttttttttgaatccac

SEQ ID NO: 14777 - DNA, 23 bp, Artificial Sequence
  Synthetic
ccgttttttttttttgccacagt

SEQ ID NO: 14778 - DNA, 23 bp, Artificial Sequence
  Synthetic
ccgttttttttttttgaacaatt

SEQ ID NO: 14779 - DNA, 23 bp, Artificial Sequence
  Synthetic
ccgttttttttttttaggggttc

SEQ ID NO: 14780 - DNA, 23 bp, Artificial Sequence
  Synthetic
ccgttttttttttttacaggcca

SEQ ID NO: 14781 - DNA, 23 bp, Artificial Sequence
  Synthetic
ccgttttttttttttctgagggt

SEQ ID NO: 14782 - DNA, 23 bp, Artificial Sequence
  Synthetic
ccgttttttttttttcggctagt

SEQ ID NO: 14783 - DNA, 23 bp, Artificial Sequence
  Synthetic
ccgttttttttttttgccttctg

SEQ ID NO: 14784 - DNA, 23 bp, Artificial Sequence
  Synthetic
ccgttttttttttttgaggggcc

SEQ ID NO: 14785 - DNA, 23 bp, Artificial Sequence
  Synthetic
ccgttttttttttttcaaaacat

SEQ ID NO: 14786 - DNA, 23 bp, Artificial Sequence
  Synthetic
ccgttttttttttttgcggacac

SEQ ID NO: 14787 - DNA, 23 bp, Artificial Sequence
  Synthetic
ccgttttttttttttcggcatta

SEQ ID NO: 14788 - DNA, 23 bp, Artificial Sequence
  Synthetic
ccgttttttttttttctgcatga

SEQ ID NO: 14789 - DNA, 23 bp, Artificial Sequence
  Synthetic
ccgttttttttttttcaccgagg

SEQ ID NO: 14790 - DNA, 23 bp, Artificial Sequence
  Synthetic
ccgttttttttttttaataatga

SEQ ID NO: 14791 - DNA, 23 bp, Artificial Sequence
  Synthetic
ccgttttttttttttgagtcgag

SEQ ID NO: 14792 - DNA, 23 bp, Artificial Sequence
  Synthetic
ccgttttttttttttgttcaaac

SEQ ID NO: 14793 - DNA, 23 bp, Artificial Sequence
  Synthetic
ccgttttttttttttgggacatc

SEQ ID NO: 14794 - DNA, 23 bp, Artificial Sequence
  Synthetic
ccgttttttttttttccagctaa

SEQ ID NO: 14795 - DNA, 23 bp, Artificial Sequence
  Synthetic
ccgttttttttttttcagctagc

SEQ ID NO: 14796 - DNA, 23 bp, Artificial Sequence
  Synthetic
ccgttttttttttttaggaacac

SEQ ID NO: 14797 - DNA, 23 bp, Artificial Sequence
  Synthetic
ccgttttttttttttcaggaaca

SEQ ID NO: 14798 - DNA, 23 bp, Artificial Sequence
  Synthetic
ccgttttttttttttgcatgcaa

SEQ ID NO: 14799 - DNA, 23 bp, Artificial Sequence
  Synthetic
ccgttttttttttttactcagta

SEQ ID NO: 14800 - DNA, 23 bp, Artificial Sequence
  Synthetic
ccgttttttttttttctcagttt

SEQ ID NO: 14801 - DNA, 23 bp, Artificial Sequence
  Synthetic
ccgttttttttttttgtgtatat

SEQ ID NO: 14802 - DNA, 23 bp, Artificial Sequence
  Synthetic
ccgttttttttttttgatgtagt

SEQ ID NO: 14803 - DNA, 23 bp, Artificial Sequence
  Synthetic
ccgttttttttttttatggacaa

SEQ ID NO: 14804 - DNA, 23 bp, Artificial Sequence
  Synthetic
ccgttttttttttttctcacaga

SEQ ID NO: 14805 - DNA, 23 bp, Artificial Sequence
  Synthetic
ccgttttttttttttacatcagt

SEQ ID NO: 14806 - DNA, 23 bp, Artificial Sequence
  Synthetic
ccgttttttttttttcttatgtg

SEQ ID NO: 14807 - DNA, 23 bp, Artificial Sequence
  Synthetic
ccgttttttttttttatatacat

SEQ ID NO: 14808 - DNA, 23 bp, Artificial Sequence
  Synthetic
ccgttttttttttttgtaggtgt

SEQ ID NO: 14809 - DNA, 23 bp, Artificial Sequence
  Synthetic
ccgttttttttttttgttggtgt

SEQ ID NO: 14810 - DNA, 23 bp, Artificial Sequence
  Synthetic
ccgttttttttttttagacacac

SEQ ID NO: 14811 - DNA, 23 bp, Artificial Sequence
  Synthetic
ccgttttttttttttgacaccaa

SEQ ID NO: 14812 - DNA, 23 bp, Artificial Sequence
  Synthetic
ccgttttttttttttaccagtgc

SEQ ID NO: 14813 - DNA, 23 bp, Artificial Sequence
  Synthetic
ccgttttttttttttgaaaagca

SEQ ID NO: 14814 - DNA, 23 bp, Artificial Sequence
  Synthetic
ccgttttttttttttcaagacgg

SEQ ID NO: 14815 - DNA, 23 bp, Artificial Sequence
  Synthetic
ccgttttttttttttcgggaggg

SEQ ID NO: 14816 - DNA, 23 bp, Artificial Sequence
  Synthetic
ccgttttttttttttagaggaga

SEQ ID NO: 14817 - DNA, 23 bp, Artificial Sequence
  Synthetic
ccgttttttttttttaattcatc

SEQ ID NO: 14818 - DNA, 23 bp, Artificial Sequence
  Synthetic
ccgttttttttttttcggggcag

SEQ ID NO: 14819 - DNA, 23 bp, Artificial Sequence
  Synthetic
ccgttttttttttttgtggatga

SEQ ID NO: 14820 - DNA, 23 bp, Artificial Sequence
  Synthetic
ccgttttttttttttagagtgct

SEQ ID NO: 14821 - DNA, 23 bp, Artificial Sequence
  Synthetic
ccgttttttttttttaccaagaa

SEQ ID NO: 14822 - DNA, 23 bp, Artificial Sequence
  Synthetic
ccgttttttttttttctgccata

SEQ ID NO: 14823 - DNA, 23 bp, Artificial Sequence
  Synthetic
ccgttttttttttttagcatgga

SEQ ID NO: 14824 - DNA, 23 bp, Artificial Sequence
  Synthetic
ccgttttttttttttctcatgga

SEQ ID NO: 14825 - DNA, 23 bp, Artificial Sequence
  Synthetic
ccgttttttttttttggtttccc

SEQ ID NO: 14826 - DNA, 23 bp, Artificial Sequence
  Synthetic
ccgttttttttttttagaagtgc

SEQ ID NO: 14827 - DNA, 23 bp, Artificial Sequence
  Synthetic
ccgttttttttttttagattggc

SEQ ID NO: 14828 - DNA, 23 bp, Artificial Sequence
  Synthetic
ccgttttttttttttcaaaccac

SEQ ID NO: 14829 - DNA, 23 bp, Artificial Sequence
  Synthetic
ccgttttttttttttaacatcac

SEQ ID NO: 14830 - DNA, 23 bp, Artificial Sequence
  Synthetic
ccgttttttttttttgaaccctt

SEQ ID NO: 14831 - DNA, 23 bp, Artificial Sequence
  Synthetic
ccgttttttttttttacccaggg

SEQ ID NO: 14832 - DNA, 23 bp, Artificial Sequence
  Synthetic
ccgttttttttttttaaatcctt

SEQ ID NO: 14833 - DNA, 23 bp, Artificial Sequence
  Synthetic
ccgttttttttttttcagtactg

SEQ ID NO: 14834 - DNA, 23 bp, Artificial Sequence
  Synthetic
ccgttttttttttttgaaaacca

SEQ ID NO: 14835 - DNA, 23 bp, Artificial Sequence
  Synthetic
ccgttttttttttttcggtccta

SEQ ID NO: 14836 - DNA, 23 bp, Artificial Sequence
  Synthetic
ccgttttttttttttcacaccaa

SEQ ID NO: 14837 - DNA, 23 bp, Artificial Sequence
  Synthetic
ccgttttttttttttcaggatcg

SEQ ID NO: 14838 - DNA, 23 bp, Artificial Sequence
  Synthetic
ccgttttttttttttgaccaaca

SEQ ID NO: 14839 - DNA, 23 bp, Artificial Sequence
  Synthetic
ccgttttttttttttagttatca

SEQ ID NO: 14840 - DNA, 23 bp, Artificial Sequence
  Synthetic
ccgttttttttttttgtgacatg

SEQ ID NO: 14841 - DNA, 23 bp, Artificial Sequence
  Synthetic
ccgttttttttttttgaagtgca

SEQ ID NO: 14842 - DNA, 23 bp, Artificial Sequence
  Synthetic
ccgttttttttttttactccgtg

SEQ ID NO: 14843 - DNA, 23 bp, Artificial Sequence
  Synthetic
ccgttttttttttttactcaaag

SEQ ID NO: 14844 - DNA, 23 bp, Artificial Sequence
  Synthetic
ccgttttttttttttactgaaac

SEQ ID NO: 14845 - DNA, 23 bp, Artificial Sequence
  Synthetic
ccgttttttttttttcatcatcg

SEQ ID NO: 14846 - DNA, 23 bp, Artificial Sequence
  Synthetic
ccgttttttttttttagagggag

SEQ ID NO: 14847 - DNA, 23 bp, Artificial Sequence
  Synthetic
ccgttttttttttttcacaaccc

SEQ ID NO: 14848 - DNA, 23 bp, Artificial Sequence
  Synthetic
ccgttttttttttttagggacct

SEQ ID NO: 14849 - DNA, 23 bp, Artificial Sequence
  Synthetic
ccgttttttttttttgctctcac

SEQ ID NO: 14850 - DNA, 23 bp, Artificial Sequence
  Synthetic
ccgttttttttttttgggctggg

SEQ ID NO: 14851 - DNA, 23 bp, Artificial Sequence
  Synthetic
ccgttttttttttttgtagtggg

SEQ ID NO: 14852 - DNA, 23 bp, Artificial Sequence
  Synthetic
ccgttttttttttttcatgaaca

SEQ ID NO: 14853 - DNA, 23 bp, Artificial Sequence
  Synthetic
ccgttttttttttttcatgcaca

SEQ ID NO: 14854 - DNA, 23 bp, Artificial Sequence
  Synthetic
ccgttttttttttttcacacatc

SEQ ID NO: 14855 - DNA, 23 bp, Artificial Sequence
  Synthetic
ccgttttttttttttaccacata

SEQ ID NO: 14856 - DNA, 23 bp, Artificial Sequence
  Synthetic
ccgttttttttttttctccagcc

SEQ ID NO: 14857 - DNA, 23 bp, Artificial Sequence
  Synthetic
ccgttttttttttttacacacag

SEQ ID NO: 14858 - DNA, 23 bp, Artificial Sequence
  Synthetic
ccgttttttttttttccaaggac

SEQ ID NO: 14859 - DNA, 23 bp, Artificial Sequence
  Synthetic
ccgttttttttttttcaccactc

SEQ ID NO: 14860 - DNA, 23 bp, Artificial Sequence
  Synthetic
ccgttttttttttttctgagatg

SEQ ID NO: 14861 - DNA, 23 bp, Artificial Sequence
  Synthetic
ccgttttttttttttctgagcgg

SEQ ID NO: 14862 - DNA, 23 bp, Artificial Sequence
  Synthetic
ccgttttttttttttctgtgggc

SEQ ID NO: 14863 - DNA, 23 bp, Artificial Sequence
  Synthetic
ccgttttttttttttgctcaaca

SEQ ID NO: 14864 - DNA, 23 bp, Artificial Sequence
  Synthetic
ccgttttttttttttcaagtcct

SEQ ID NO: 14865 - DNA, 23 bp, Artificial Sequence
  Synthetic
ccgttttttttttttagaagcta

SEQ ID NO: 14866 - DNA, 23 bp, Artificial Sequence
  Synthetic
ccgttttttttttttctccagtc

SEQ ID NO: 14867 - DNA, 23 bp, Artificial Sequence
  Synthetic
ccgttttttttttttccaagagt

SEQ ID NO: 14868 - DNA, 23 bp, Artificial Sequence
  Synthetic
ccgttttttttttttccccatgt

SEQ ID NO: 14869 - DNA, 23 bp, Artificial Sequence
  Synthetic
ccgttttttttttttgctgcctg

SEQ ID NO: 14870 - DNA, 23 bp, Artificial Sequence
  Synthetic
ccgttttttttttttagacttca

SEQ ID NO: 14871 - DNA, 23 bp, Artificial Sequence
  Synthetic
ccgttttttttttttaggacaca

SEQ ID NO: 14872 - DNA, 23 bp, Artificial Sequence
  Synthetic
ccgttttttttttttacttgaag

SEQ ID NO: 14873 - DNA, 23 bp, Artificial Sequence
  Synthetic
ccgttttttttttttgcctcacc

SEQ ID NO: 14874 - DNA, 23 bp, Artificial Sequence
  Synthetic
ccgttttttttttttcaccgtct

SEQ ID NO: 14875 - DNA, 23 bp, Artificial Sequence
  Synthetic
ccgttttttttttttattgctgc

SEQ ID NO: 14876 - DNA, 23 bp, Artificial Sequence
  Synthetic
ccgttttttttttttaataagta

SEQ ID NO: 14877 - DNA, 23 bp, Artificial Sequence
  Synthetic
ccgttttttttttttgaccccgc

SEQ ID NO: 14878 - DNA, 23 bp, Artificial Sequence
  Synthetic
ccgttttttttttttgttgtgag

SEQ ID NO: 14879 - DNA, 23 bp, Artificial Sequence
  Synthetic
ccgttttttttttttgcctctct

SEQ ID NO: 14880 - DNA, 23 bp, Artificial Sequence
  Synthetic
ccgttttttttttttagtgaggc

SEQ ID NO: 14881 - DNA, 23 bp, Artificial Sequence
  Synthetic
ccgttttttttttttcagccaca

SEQ ID NO: 14882 - DNA, 23 bp, Artificial Sequence
  Synthetic
ccgttttttttttttaaaacttt

SEQ ID NO: 14883 - DNA, 23 bp, Artificial Sequence
  Synthetic
ccgttttttttttttcaggcaac

SEQ ID NO: 14884 - DNA, 23 bp, Artificial Sequence
  Synthetic
ccgttttttttttttagtcacct

SEQ ID NO: 14885 - DNA, 23 bp, Artificial Sequence
  Synthetic
ccgttttttttttttccacagca

SEQ ID NO: 14886 - DNA, 23 bp, Artificial Sequence
  Synthetic
ccgttttttttttttccacagga

SEQ ID NO: 14887 - DNA, 23 bp, Artificial Sequence
  Synthetic
ccgttttttttttttgggaagga

SEQ ID NO: 14888 - DNA, 23 bp, Artificial Sequence
  Synthetic
ccgttttttttttttgagccagg

SEQ ID NO: 14889 - DNA, 23 bp, Artificial Sequence
  Synthetic
ccgttttttttttttaacaaaat

SEQ ID NO: 14890 - DNA, 23 bp, Artificial Sequence
  Synthetic
ccgttttttttttttgtggactc

SEQ ID NO: 14891 - DNA, 23 bp, Artificial Sequence
  Synthetic
ccgttttttttttttcatctatt

SEQ ID NO: 14892 - DNA, 23 bp, Artificial Sequence
  Synthetic
ccgttttttttttttagcggggt

SEQ ID NO: 14893 - DNA, 23 bp, Artificial Sequence
  Synthetic
ccgttttttttttttccttctga

SEQ ID NO: 14894 - DNA, 23 bp, Artificial Sequence
  Synthetic
ccgttttttttttttaggagcag

SEQ ID NO: 14895 - DNA, 23 bp, Artificial Sequence
  Synthetic
ccgttttttttttttcccacccc

SEQ ID NO: 14896 - DNA, 23 bp, Artificial Sequence
  Synthetic
ccgttttttttttttagacaggg

SEQ ID NO: 14897 - DNA, 23 bp, Artificial Sequence
  Synthetic
ccgttttttttttttgtaggcaa

SEQ ID NO: 14898 - DNA, 23 bp, Artificial Sequence
  Synthetic
ccgttttttttttttgaagctca

SEQ ID NO: 14899 - DNA, 23 bp, Artificial Sequence
  Synthetic
ccgttttttttttttctcctgcc

SEQ ID NO: 14900 - DNA, 23 bp, Artificial Sequence
  Synthetic
ccgttttttttttttcaactctc

SEQ ID NO: 14901 - DNA, 23 bp, Artificial Sequence
  Synthetic
ccgttttttttttttacatctct

SEQ ID NO: 14902 - DNA, 23 bp, Artificial Sequence
  Synthetic
ccgttttttttttttgtaccgcc

SEQ ID NO: 14903 - DNA, 23 bp, Artificial Sequence
  Synthetic
ccgttttttttttttaacacccg

SEQ ID NO: 14904 - DNA, 23 bp, Artificial Sequence
  Synthetic
ccgttttttttttttctgtgtgc

SEQ ID NO: 14905 - DNA, 23 bp, Artificial Sequence
  Synthetic
ccgttttttttttttcgaccgac

SEQ ID NO: 14906 - DNA, 23 bp, Artificial Sequence
  Synthetic
ccgttttttttttttacgcgggg

SEQ ID NO: 14907 - DNA, 23 bp, Artificial Sequence
  Synthetic
ccgttttttttttttgagaaggt

SEQ ID NO: 14908 - DNA, 23 bp, Artificial Sequence
  Synthetic
ccgttttttttttttgacacccg

SEQ ID NO: 14909 - DNA, 23 bp, Artificial Sequence
  Synthetic
ccgttttttttttttacattttt

SEQ ID NO: 14910 - DNA, 23 bp, Artificial Sequence
  Synthetic
ccgttttttttttttgaggcccc

SEQ ID NO: 14911 - DNA, 23 bp, Artificial Sequence
  Synthetic
ccgttttttttttttcccctttt

SEQ ID NO: 14912 - DNA, 23 bp, Artificial Sequence
  Synthetic
ccgttttttttttttctgttagc

SEQ ID NO: 14913 - DNA, 23 bp, Artificial Sequence
  Synthetic
ccgttttttttttttgtggacca

SEQ ID NO: 14914 - DNA, 23 bp, Artificial Sequence
  Synthetic
ccgttttttttttttcaaaattg

SEQ ID NO: 14915 - DNA, 23 bp, Artificial Sequence
  Synthetic
ccgttttttttttttccccacag

SEQ ID NO: 14916 - DNA, 23 bp, Artificial Sequence
  Synthetic
ccgttttttttttttgtcagttt

SEQ ID NO: 14917 - DNA, 23 bp, Artificial Sequence
  Synthetic
ccgttttttttttttctctgtcc

SEQ ID NO: 14918 - DNA, 23 bp, Artificial Sequence
  Synthetic
ccgttttttttttttccactggt

SEQ ID NO: 14919 - DNA, 23 bp, Artificial Sequence
  Synthetic
ccgttttttttttttcagttgcc

SEQ ID NO: 14920 - DNA, 23 bp, Artificial Sequence
  Synthetic
ccgttttttttttttggaggaca

SEQ ID NO: 14921 - DNA, 23 bp, Artificial Sequence
  Synthetic
ccgttttttttttttcagctcca

SEQ ID NO: 14922 - DNA, 23 bp, Artificial Sequence
  Synthetic
ccgttttttttttttacaaaatc

SEQ ID NO: 14923 - DNA, 23 bp, Artificial Sequence
  Synthetic
ccgttttttttttttcgattccg

SEQ ID NO: 14924 - DNA, 23 bp, Artificial Sequence
  Synthetic
ccgttttttttttttaggatgaa

SEQ ID NO: 14925 - DNA, 23 bp, Artificial Sequence
  Synthetic
ccgttttttttttttcaggtgag

SEQ ID NO: 14926 - DNA, 23 bp, Artificial Sequence
  Synthetic
ccgttttttttttttcctatgtc

SEQ ID NO: 14927 - DNA, 23 bp, Artificial Sequence
  Synthetic
ccgttttttttttttatacagct

SEQ ID NO: 14928 - DNA, 23 bp, Artificial Sequence
  Synthetic
ccgttttttttttttctttcggt

SEQ ID NO: 14929 - DNA, 23 bp, Artificial Sequence
  Synthetic
ccgttttttttttttaggccggg

SEQ ID NO: 14930 - DNA, 23 bp, Artificial Sequence
  Synthetic
ccgttttttttttttacctgcac

SEQ ID NO: 14931 - DNA, 23 bp, Artificial Sequence
  Synthetic
ccgttttttttttttgcaaaaat

SEQ ID NO: 14932 - DNA, 23 bp, Artificial Sequence
  Synthetic
ccgttttttttttttacaataca

SEQ ID NO: 14933 - DNA, 23 bp, Artificial Sequence
  Synthetic
ccgttttttttttttcaagatcg

SEQ ID NO: 14934 - DNA, 23 bp, Artificial Sequence
  Synthetic
ccgttttttttttttgcaaggtc

SEQ ID NO: 14935 - DNA, 23 bp, Artificial Sequence
  Synthetic
ccgttttttttttttcagttatc

SEQ ID NO: 14936 - DNA, 23 bp, Artificial Sequence
  Synthetic
ccgttttttttttttatagccct

SEQ ID NO: 14937 - DNA, 23 bp, Artificial Sequence
  Synthetic
ccgttttttttttttcaggagtc

SEQ ID NO: 14938 - DNA, 23 bp, Artificial Sequence
  Synthetic
ccgttttttttttttctacctgc

SEQ ID NO: 14939 - DNA, 23 bp, Artificial Sequence
  Synthetic
ccgttttttttttttctgcactg

SEQ ID NO: 14940 - DNA, 23 bp, Artificial Sequence
  Synthetic
ccgttttttttttttatagccct

SEQ ID NO: 14941 - DNA, 23 bp, Artificial Sequence
  Synthetic
ccgttttttttttttcaaattcg

SEQ ID NO: 14942 - DNA, 23 bp, Artificial Sequence
  Synthetic
ccgttttttttttttacaagtta

SEQ ID NO: 14943 - DNA, 23 bp, Artificial Sequence
  Synthetic
ccgttttttttttttgccaagct

SEQ ID NO: 14944 - DNA, 23 bp, Artificial Sequence
  Synthetic
ccgttttttttttttccctttta

SEQ ID NO: 14945 - DNA, 23 bp, Artificial Sequence
  Synthetic
ccgttttttttttttcagctggt

SEQ ID NO: 14946 - DNA, 23 bp, Artificial Sequence
  Synthetic
ccgttttttttttttcctctggt

SEQ ID NO: 14947 - DNA, 23 bp, Artificial Sequence
  Synthetic
ccgttttttttttttaccatagg

SEQ ID NO: 14948 - DNA, 23 bp, Artificial Sequence
  Synthetic
ccgttttttttttttagtacatc

SEQ ID NO: 14949 - DNA, 23 bp, Artificial Sequence
  Synthetic
ccgttttttttttttagggattc

SEQ ID NO: 14950 - DNA, 23 bp, Artificial Sequence
  Synthetic
ccgttttttttttttcagaagca

SEQ ID NO: 14951 - DNA, 23 bp, Artificial Sequence
  Synthetic
ccgttttttttttttacttttgt

SEQ ID NO: 14952 - DNA, 23 bp, Artificial Sequence
  Synthetic
ccgttttttttttttgaaggcaa

SEQ ID NO: 14953 - DNA, 23 bp, Artificial Sequence
  Synthetic
ccgttttttttttttacaaacca

SEQ ID NO: 14954 - DNA, 23 bp, Artificial Sequence
  Synthetic
ccgttttttttttttaaaccatg

SEQ ID NO: 14955 - DNA, 23 bp, Artificial Sequence
  Synthetic
ccgttttttttttttgccaatat

SEQ ID NO: 14956 - DNA, 23 bp, Artificial Sequence
  Synthetic
ccgttttttttttttcaagtgcc

SEQ ID NO: 14957 - DNA, 23 bp, Artificial Sequence
  Synthetic
ccgttttttttttttctacctgc

SEQ ID NO: 14958 - DNA, 23 bp, Artificial Sequence
  Synthetic
ccgttttttttttttctgcacta

SEQ ID NO: 14959 - DNA, 23 bp, Artificial Sequence
  Synthetic
ccgttttttttttttctcaccga

SEQ ID NO: 14960 - DNA, 23 bp, Artificial Sequence
  Synthetic
ccgttttttttttttgtacaatc

SEQ ID NO: 14961 - DNA, 23 bp, Artificial Sequence
  Synthetic
ccgttttttttttttacccaccg

SEQ ID NO: 14962 - DNA, 23 bp, Artificial Sequence
  Synthetic
ccgttttttttttttagtgaatt

SEQ ID NO: 14963 - DNA, 23 bp, Artificial Sequence
  Synthetic
ccgttttttttttttcccttatc

SEQ ID NO: 14964 - DNA, 23 bp, Artificial Sequence
  Synthetic
ccgttttttttttttggctgcaa

SEQ ID NO: 14965 - DNA, 23 bp, Artificial Sequence
  Synthetic
ccgttttttttttttccctccac

SEQ ID NO: 14966 - DNA, 23 bp, Artificial Sequence
  Synthetic
ccgttttttttttttctgatatc

SEQ ID NO: 14967 - DNA, 23 bp, Artificial Sequence
  Synthetic
ccgttttttttttttcacatgga

SEQ ID NO: 14968 - DNA, 23 bp, Artificial Sequence
  Synthetic
ccgttttttttttttccgggtgg

SEQ ID NO: 14969 - DNA, 23 bp, Artificial Sequence
  Synthetic
ccgttttttttttttctatttcc

SEQ ID NO: 14970 - DNA, 23 bp, Artificial Sequence
  Synthetic
ccgttttttttttttaacaggta

SEQ ID NO: 14971 - DNA, 23 bp, Artificial Sequence
  Synthetic
ccgttttttttttttagttttgc

SEQ ID NO: 14972 - DNA, 23 bp, Artificial Sequence
  Synthetic
ccgttttttttttttagttttgc

SEQ ID NO: 14973 - DNA, 23 bp, Artificial Sequence
  Synthetic
ccgttttttttttttcctgcact

SEQ ID NO: 14974 - DNA, 23 bp, Artificial Sequence
  Synthetic
ccgttttttttttttggcatagg

SEQ ID NO: 14975 - DNA, 23 bp, Artificial Sequence
  Synthetic
ccgttttttttttttagactccg

SEQ ID NO: 14976 - DNA, 23 bp, Artificial Sequence
  Synthetic
ccgttttttttttttcacacact

SEQ ID NO: 14977 - DNA, 23 bp, Artificial Sequence
  Synthetic
ccgttttttttttttaacatcag

SEQ ID NO: 14978 - DNA, 23 bp, Artificial Sequence
  Synthetic
ccgttttttttttttggcgaagg

SEQ ID NO: 14979 - DNA, 23 bp, Artificial Sequence
  Synthetic
ccgttttttttttttgcctgtct

SEQ ID NO: 14980 - DNA, 23 bp, Artificial Sequence
  Synthetic
ccgttttttttttttctgtcaat

SEQ ID NO: 14981 - DNA, 23 bp, Artificial Sequence
  Synthetic
ccgttttttttttttcatggtta

SEQ ID NO: 14982 - DNA, 23 bp, Artificial Sequence
  Synthetic
ccgttttttttttttcagttctt

SEQ ID NO: 14983 - DNA, 23 bp, Artificial Sequence
  Synthetic
ccgttttttttttttaagtgtca

SEQ ID NO: 14984 - DNA, 23 bp, Artificial Sequence
  Synthetic
ccgttttttttttttaacggaac

SEQ ID NO: 14985 - DNA, 23 bp, Artificial Sequence
  Synthetic
ccgttttttttttttgaaatccc

SEQ ID NO: 14986 - DNA, 23 bp, Artificial Sequence
  Synthetic
ccgttttttttttttgttcctgc

SEQ ID NO: 14987 - DNA, 23 bp, Artificial Sequence
  Synthetic
ccgttttttttttttagaccgag

SEQ ID NO: 14988 - DNA, 23 bp, Artificial Sequence
  Synthetic
ccgttttttttttttgcctatcc

SEQ ID NO: 14989 - DNA, 23 bp, Artificial Sequence
  Synthetic
ccgttttttttttttgcggaact

SEQ ID NO: 14990 - DNA, 23 bp, Artificial Sequence
  Synthetic
ccgttttttttttttcaatagac

SEQ ID NO: 14991 - DNA, 23 bp, Artificial Sequence
  Synthetic
ccgttttttttttttaccgattt

SEQ ID NO: 14992 - DNA, 23 bp, Artificial Sequence
  Synthetic
ccgttttttttttttctgatttc

SEQ ID NO: 14993 - DNA, 23 bp, Artificial Sequence
  Synthetic
ccgttttttttttttctgagtgt

SEQ ID NO: 14994 - DNA, 23 bp, Artificial Sequence
  Synthetic
ccgttttttttttttctgagagt

SEQ ID NO: 14995 - DNA, 23 bp, Artificial Sequence
  Synthetic
ccgttttttttttttccagtcgg

SEQ ID NO: 14996 - DNA, 23 bp, Artificial Sequence
  Synthetic
ccgttttttttttttagctatgc

SEQ ID NO: 14997 - DNA, 23 bp, Artificial Sequence
  Synthetic
ccgttttttttttttcaacttag

SEQ ID NO: 14998 - DNA, 23 bp, Artificial Sequence
  Synthetic
ccgttttttttttttaatgcaac

SEQ ID NO: 14999 - DNA, 23 bp, Artificial Sequence
  Synthetic
ccgttttttttttttcaaccagc

SEQ ID NO: 15000 - DNA, 23 bp, Artificial Sequence
  Synthetic
ccgttttttttttttacaaaatc

SEQ ID NO: 15001 - DNA, 23 bp, Artificial Sequence
  Synthetic
ccgttttttttttttatacagct

SEQ ID NO: 15002 - DNA, 23 bp, Artificial Sequence
  Synthetic
ccgttttttttttttcaggccgg

SEQ ID NO: 15003 - DNA, 23 bp, Artificial Sequence
  Synthetic
ccgttttttttttttacctgcac

SEQ ID NO: 15004 - DNA, 23 bp, Artificial Sequence
  Synthetic
ccgttttttttttttcaaaaatg

SEQ ID NO: 15005 - DNA, 23 bp, Artificial Sequence
  Synthetic
ccgttttttttttttacaagatc

SEQ ID NO: 15006 - DNA, 23 bp, Artificial Sequence
  Synthetic
ccgttttttttttttgctctctc

SEQ ID NO: 15007 - DNA, 23 bp, Artificial Sequence
  Synthetic
ccgttttttttttttgcatacag

SEQ ID NO: 15008 - DNA, 23 bp, Artificial Sequence
  Synthetic
ccgttttttttttttggatgcag

SEQ ID NO: 15009 - DNA, 23 bp, Artificial Sequence
  Synthetic
ccgttttttttttttgggaatga

SEQ ID NO: 15010 - DNA, 23 bp, Artificial Sequence
  Synthetic
ccgttttttttttttggcaagtc

SEQ ID NO: 15011 - DNA, 23 bp, Artificial Sequence
  Synthetic
ccgttttttttttttggcaagtc

SEQ ID NO: 15012 - DNA, 23 bp, Artificial Sequence
  Synthetic
ccgttttttttttttatattggc

SEQ ID NO: 15013 - DNA, 23 bp, Artificial Sequence
  Synthetic
ccgttttttttttttggagctcc

SEQ ID NO: 15014 - DNA, 23 bp, Artificial Sequence
  Synthetic
ccgttttttttttttatcaatgc

SEQ ID NO: 15015 - DNA, 23 bp, Artificial Sequence
  Synthetic
ccgttttttttttttagttcccc

SEQ ID NO: 15016 - DNA, 23 bp, Artificial Sequence
  Synthetic
ccgttttttttttttagttcccc

SEQ ID NO: 15017 - DNA, 23 bp, Artificial Sequence
  Synthetic
ccgttttttttttttagttcccc

SEQ ID NO: 15018 - DNA, 23 bp, Artificial Sequence
  Synthetic
ccgttttttttttttagttcccc

SEQ ID NO: 15019 - DNA, 23 bp, Artificial Sequence
  Synthetic
ccgttttttttttttagttcccc

SEQ ID NO: 15020 - DNA, 23 bp, Artificial Sequence
  Synthetic
ccgttttttttttttagttcccc

SEQ ID NO: 15021 - DNA, 23 bp, Artificial Sequence
  Synthetic
ccgttttttttttttagttcccc

SEQ ID NO: 15022 - DNA, 23 bp, Artificial Sequence
  Synthetic
ccgttttttttttttagttcccc

SEQ ID NO: 15023 - DNA, 23 bp, Artificial Sequence
  Synthetic
ccgttttttttttttagttcccc

SEQ ID NO: 15024 - DNA, 23 bp, Artificial Sequence
  Synthetic
ccgttttttttttttagttcccc

SEQ ID NO: 15025 - DNA, 23 bp, Artificial Sequence
  Synthetic
ccgttttttttttttagttcccc

SEQ ID NO: 15026 - DNA, 23 bp, Artificial Sequence
  Synthetic
ccgttttttttttttagttcccc

SEQ ID NO: 15027 - DNA, 23 bp, Artificial Sequence
  Synthetic
ccgttttttttttttagttcccc

SEQ ID NO: 15028 - DNA, 23 bp, Artificial Sequence
  Synthetic
ccgttttttttttttagttcccc

SEQ ID NO: 15029 - DNA, 23 bp, Artificial Sequence
  Synthetic
ccgttttttttttttagttcccc

SEQ ID NO: 15030 - DNA, 23 bp, Artificial Sequence
  Synthetic
ccgttttttttttttagttcccc

SEQ ID NO: 15031 - DNA, 23 bp, Artificial Sequence
  Synthetic
ccgttttttttttttgggcaaat

SEQ ID NO: 15032 - DNA, 23 bp, Artificial Sequence
  Synthetic
ccgttttttttttttagggcagc

SEQ ID NO: 15033 - DNA, 23 bp, Artificial Sequence
  Synthetic
ccgttttttttttttagggcaaa

SEQ ID NO: 15034 - DNA, 23 bp, Artificial Sequence
  Synthetic
ccgttttttttttttgggcagct

SEQ ID NO: 15035 - DNA, 23 bp, Artificial Sequence
  Synthetic
ccgttttttttttttgggcaaat

SEQ ID NO: 15036 - DNA, 23 bp, Artificial Sequence
  Synthetic
ccgttttttttttttgccaagct

SEQ ID NO: 15037 - DNA, 23 bp, Artificial Sequence
  Synthetic
ccgttttttttttttcatcatca

SEQ ID NO: 15038 - DNA, 23 bp, Artificial Sequence
  Synthetic
ccgttttttttttttctgcatga

SEQ ID NO: 15039 - DNA, 23 bp, Artificial Sequence
  Synthetic
ccgttttttttttttcacccaat

SEQ ID NO: 15040 - DNA, 23 bp, Artificial Sequence
  Synthetic
ccgttttttttttttgctcactc

SEQ ID NO: 15041 - DNA, 23 bp, Artificial Sequence
  Synthetic
ccgttttttttttttgctcactc

SEQ ID NO: 15042 - DNA, 23 bp, Artificial Sequence
  Synthetic
ccgttttttttttttgctcactc

SEQ ID NO: 15043 - DNA, 23 bp, Artificial Sequence
  Synthetic
ccgttttttttttttgctcactc

SEQ ID NO: 15044 - DNA, 23 bp, Artificial Sequence
  Synthetic
ccgttttttttttttgctcactc

SEQ ID NO: 15045 - DNA, 23 bp, Artificial Sequence
  Synthetic
ccgttttttttttttgctcactc

SEQ ID NO: 15046 - DNA, 23 bp, Artificial Sequence
  Synthetic
ccgttttttttttttgctcactc

SEQ ID NO: 15047 - DNA, 23 bp, Artificial Sequence
  Synthetic
ccgttttttttttttgctcactc

SEQ ID NO: 15048 - DNA, 23 bp, Artificial Sequence
  Synthetic
ccgttttttttttttgctcactc

SEQ ID NO: 15049 - DNA, 23 bp, Artificial Sequence
  Synthetic
ccgttttttttttttgctcactc

SEQ ID NO: 15050 - DNA, 23 bp, Artificial Sequence
  Synthetic
ccgttttttttttttgctctctc

SEQ ID NO: 15051 - DNA, 23 bp, Artificial Sequence
  Synthetic
ccgttttttttttttgctcactc

SEQ ID NO: 15052 - DNA, 23 bp, Artificial Sequence
  Synthetic
ccgttttttttttttagagctcc

SEQ ID NO: 15053 - DNA, 23 bp, Artificial Sequence
  Synthetic
ccgttttttttttttagagctcc

SEQ ID NO: 15054 - DNA, 23 bp, Artificial Sequence
  Synthetic
ccgttttttttttttgagctccc

SEQ ID NO: 15055 - DNA, 23 bp, Artificial Sequence
  Synthetic
ccgttttttttttttggagctcc

SEQ ID NO: 15056 - DNA, 23 bp, Artificial Sequence
  Synthetic
ccgttttttttttttggagctcc

SEQ ID NO: 15057 - DNA, 23 bp, Artificial Sequence
  Synthetic
ccgttttttttttttgagctccc

SEQ ID NO: 15058 - DNA, 23 bp, Artificial Sequence
  Synthetic
ccgttttttttttttgcatacag

SEQ ID NO: 15059 - DNA, 23 bp, Artificial Sequence
  Synthetic
ccgttttttttttttgcatacag

SEQ ID NO: 15060 - DNA, 23 bp, Artificial Sequence
  Synthetic
ccgttttttttttttgcatacag

SEQ ID NO: 15061 - DNA, 23 bp, Artificial Sequence
  Synthetic
ccgttttttttttttgcatacag

SEQ ID NO: 15062 - DNA, 23 bp, Artificial Sequence
  Synthetic
ccgttttttttttttggcataca

SEQ ID NO: 15063 - DNA, 23 bp, Artificial Sequence
  Synthetic
ccgttttttttttttgcattcag

SEQ ID NO: 15064 - DNA, 23 bp, Artificial Sequence
  Synthetic
ccgttttttttttttggatgcag

SEQ ID NO: 15065 - DNA, 23 bp, Artificial Sequence
  Synthetic
ccgttttttttttttggatgcag

SEQ ID NO: 15066 - DNA, 23 bp, Artificial Sequence
  Synthetic
ccgttttttttttttcacgtgcc

SEQ ID NO: 15067 - DNA, 23 bp, Artificial Sequence
  Synthetic
ccgttttttttttttcacgtgcc

SEQ ID NO: 15068 - DNA, 23 bp, Artificial Sequence
  Synthetic
ccgttttttttttttcacgtacc

SEQ ID NO: 15069 - DNA, 23 bp, Artificial Sequence
  Synthetic
ccgttttttttttttgcacgtgc

SEQ ID NO: 15070 - DNA, 23 bp, Artificial Sequence
  Synthetic
ccgttttttttttttcacgtgcc

SEQ ID NO: 15071 - DNA, 23 bp, Artificial Sequence
  Synthetic
ccgttttttttttttcacgtgcc

SEQ ID NO: 15072 - DNA, 23 bp, Artificial Sequence
  Synthetic
ccgttttttttttttgggaatga

SEQ ID NO: 15073 - DNA, 23 bp, Artificial Sequence
  Synthetic
ccgttttttttttttgggaatga

SEQ ID NO: 15074 - DNA, 23 bp, Artificial Sequence
  Synthetic
ccgttttttttttttgggaatga

SEQ ID NO: 15075 - DNA, 23 bp, Artificial Sequence
  Synthetic
ccgttttttttttttgggaatga

SEQ ID NO: 15076 - DNA, 23 bp, Artificial Sequence
  Synthetic
ccgttttttttttttgggaatga

SEQ ID NO: 15077 - DNA, 23 bp, Artificial Sequence
  Synthetic
ccgttttttttttttgggaatga

SEQ ID NO: 15078 - DNA, 23 bp, Artificial Sequence
  Synthetic
ccgttttttttttttaggaatga

SEQ ID NO: 15079 - DNA, 23 bp, Artificial Sequence
  Synthetic
ccgttttttttttttaggaatga

SEQ ID NO: 15080 - DNA, 23 bp, Artificial Sequence
  Synthetic
ccgttttttttttttaggaatga

SEQ ID NO: 15081 - DNA, 23 bp, Artificial Sequence
  Synthetic
ccgttttttttttttaggaatga

SEQ ID NO: 15082 - DNA, 23 bp, Artificial Sequence
  Synthetic
ccgttttttttttttgggattga

SEQ ID NO: 15083 - DNA, 23 bp, Artificial Sequence
  Synthetic
ccgttttttttttttgggattga

SEQ ID NO: 15084 - DNA, 23 bp, Artificial Sequence
  Synthetic
ccgttttttttttttgggaatga

SEQ ID NO: 15085 - DNA, 23 bp, Artificial Sequence
  Synthetic
ccgttttttttttttgggaatga

SEQ ID NO: 15086 - DNA, 23 bp, Artificial Sequence
  Synthetic
ccgttttttttttttgatcatgc

SEQ ID NO: 15087 - DNA, 23 bp, Artificial Sequence
  Synthetic
ccgttttttttttttgatcatgc

SEQ ID NO: 15088 - DNA, 23 bp, Artificial Sequence
  Synthetic
ccgttttttttttttgatcatgc

SEQ ID NO: 15089 - DNA, 23 bp, Artificial Sequence
  Synthetic
ccgttttttttttttagatcatg

SEQ ID NO: 15090 - DNA, 23 bp, Artificial Sequence
  Synthetic
ccgttttttttttttagatcatg

SEQ ID NO: 15091 - DNA, 23 bp, Artificial Sequence
  Synthetic
ccgttttttttttttagatcatg

SEQ ID NO: 15092 - DNA, 23 bp, Artificial Sequence
  Synthetic
ccgttttttttttttagatcatg

SEQ ID NO: 15093 - DNA, 23 bp, Artificial Sequence
  Synthetic
ccgttttttttttttagatcatg

SEQ ID NO: 15094 - DNA, 23 bp, Artificial Sequence
  Synthetic
ccgttttttttttttagatcatg

SEQ ID NO: 15095 - DNA, 23 bp, Artificial Sequence
  Synthetic
ccgttttttttttttagatcatg

SEQ ID NO: 15096 - DNA, 23 bp, Artificial Sequence
  Synthetic
ccgttttttttttttcccgatct

SEQ ID NO: 15097 - DNA, 23 bp, Artificial Sequence
  Synthetic
ccgttttttttttttccgagctg

SEQ ID NO: 15098 - DNA, 23 bp, Artificial Sequence
  Synthetic
ccgttttttttttttggcaagtc

SEQ ID NO: 15099 - DNA, 23 bp, Artificial Sequence
  Synthetic
ccgttttttttttttcggcaagt

SEQ ID NO: 15100 - DNA, 23 bp, Artificial Sequence
  Synthetic
ccgttttttttttttcggcaagt

SEQ ID NO: 15101 - DNA, 23 bp, Artificial Sequence
  Synthetic
ccgttttttttttttcggcaatt

SEQ ID NO: 15102 - DNA, 23 bp, Artificial Sequence
  Synthetic
ccgttttttttttttcggcaagt

SEQ ID NO: 15103 - DNA, 23 bp, Artificial Sequence
  Synthetic
ccgttttttttttttggcaagtc

SEQ ID NO: 15104 - DNA, 23 bp, Artificial Sequence
  Synthetic
ccgttttttttttttggcaagtc

SEQ ID NO: 15105 - DNA, 23 bp, Artificial Sequence
  Synthetic
ccgttttttttttttaggcaagt

SEQ ID NO: 15106 - DNA, 23 bp, Artificial Sequence
  Synthetic
ccgttttttttttttaggcaagt

SEQ ID NO: 15107 - DNA, 23 bp, Artificial Sequence
  Synthetic
ccgttttttttttttaggcaagt

SEQ ID NO: 15108 - DNA, 23 bp, Artificial Sequence
  Synthetic
ccgttttttttttttaggcaagt

SEQ ID NO: 15109 - DNA, 23 bp, Artificial Sequence
  Synthetic
ccgttttttttttttaggcaagt

SEQ ID NO: 15110 - DNA, 23 bp, Artificial Sequence
  Synthetic
ccgttttttttttttaggcaagt

SEQ ID NO: 15111 - DNA, 23 bp, Artificial Sequence
  Synthetic
ccgttttttttttttggcaagtc

SEQ ID NO: 15112 - DNA, 23 bp, Artificial Sequence
  Synthetic
ccgttttttttttttggcaagtc

SEQ ID NO: 15113 - DNA, 23 bp, Artificial Sequence
  Synthetic
ccgttttttttttttcggcaagt

SEQ ID NO: 15114 - DNA, 23 bp, Artificial Sequence
  Synthetic
ccgttttttttttttatgggcag

SEQ ID NO: 15115 - DNA, 23 bp, Artificial Sequence
  Synthetic
ccgttttttttttttatattggc

SEQ ID NO: 15116 - DNA, 23 bp, Artificial Sequence
  Synthetic
ccgttttttttttttatattggc

SEQ ID NO: 15117 - DNA, 23 bp, Artificial Sequence
  Synthetic
ccgttttttttttttatattggc

SEQ ID NO: 15118 - DNA, 23 bp, Artificial Sequence
  Synthetic
ccgttttttttttttatattggc

SEQ ID NO: 15119 - DNA, 23 bp, Artificial Sequence
  Synthetic
ccgttttttttttttatattggc

SEQ ID NO: 15120 - DNA, 23 bp, Artificial Sequence
  Synthetic
ccgttttttttttttatattggc

SEQ ID NO: 15121 - DNA, 23 bp, Artificial Sequence
  Synthetic
ccgttttttttttttatattggc

SEQ ID NO: 15122 - DNA, 23 bp, Artificial Sequence
  Synthetic
ccgttttttttttttgtgatatt

SEQ ID NO: 15123 - DNA, 23 bp, Artificial Sequence
  Synthetic
ccgttttttttttttatattgac

SEQ ID NO: 15124 - DNA, 23 bp, Artificial Sequence
  Synthetic
ccgttttttttttttgcagcatc

SEQ ID NO: 15125 - DNA, 23 bp, Artificial Sequence
  Synthetic
ccgttttttttttttgcagcatc

SEQ ID NO: 15126 - DNA, 23 bp, Artificial Sequence
  Synthetic
ccgttttttttttttgcagcatc

SEQ ID NO: 15127 - DNA, 23 bp, Artificial Sequence
  Synthetic
ccgttttttttttttgcagcatc

SEQ ID NO: 15128 - DNA, 23 bp, Artificial Sequence
  Synthetic
ccgttttttttttttggagcacc

SEQ ID NO: 15129 - DNA, 23 bp, Artificial Sequence
  Synthetic
ccgttttttttttttggagcacc

SEQ ID NO: 15130 - DNA, 23 bp, Artificial Sequence
  Synthetic
ccgttttttttttttgcgctatc

SEQ ID NO: 15131 - DNA, 23 bp, Artificial Sequence
  Synthetic
ccgttttttttttttatcaatgc

SEQ ID NO: 15132 - DNA, 23 bp, Artificial Sequence
  Synthetic
ccgttttttttttttgatcaatg

SEQ ID NO: 15133 - DNA, 23 bp, Artificial Sequence
  Synthetic
ccgttttttttttttgaggtgga

SEQ ID NO: 15134 - DNA, 23 bp, Artificial Sequence
  Synthetic
ccgttttttttttttagttcccc

SEQ ID NO: 15135 - DNA, 23 bp, Artificial Sequence
  Synthetic
ccgttttttttttttagttcccc

SEQ ID NO: 15136 - DNA, 23 bp, Artificial Sequence
  Synthetic
ccgttttttttttttagttcctc

SEQ ID NO: 15137 - DNA, 23 bp, Artificial Sequence
  Synthetic
ccgttttttttttttagttcccc

SEQ ID NO: 15138 - DNA, 23 bp, Artificial Sequence
  Synthetic
ccgttttttttttttagttcccc

SEQ ID NO: 15139 - DNA, 23 bp, Artificial Sequence
  Synthetic
ccgttttttttttttagttcccc

SEQ ID NO: 15140 - DNA, 23 bp, Artificial Sequence
  Synthetic
ccgttttttttttttagttcccc

SEQ ID NO: 15141 - DNA, 23 bp, Artificial Sequence
  Synthetic
ccgttttttttttttagttcccc

SEQ ID NO: 15142 - DNA, 23 bp, Artificial Sequence
  Synthetic
ccgttttttttttttagttcccc

SEQ ID NO: 15143 - DNA, 23 bp, Artificial Sequence
  Synthetic
ccgttttttttttttagttcccc

SEQ ID NO: 15144 - DNA, 23 bp, Artificial Sequence
  Synthetic
ccgttttttttttttagttcccc

SEQ ID NO: 15145 - DNA, 23 bp, Artificial Sequence
  Synthetic
ccgttttttttttttagttcccc

SEQ ID NO: 15146 - DNA, 23 bp, Artificial Sequence
  Synthetic
ccgttttttttttttagttcccc

SEQ ID NO: 15147 - DNA, 23 bp, Artificial Sequence
  Synthetic
ccgttttttttttttagttcccc

SEQ ID NO: 15148 - DNA, 23 bp, Artificial Sequence
  Synthetic
ccgttttttttttttagttcctc

SEQ ID NO: 15149 - DNA, 23 bp, Artificial Sequence
  Synthetic
ccgttttttttttttagttcccc

SEQ ID NO: 15150 - DNA, 23 bp, Artificial Sequence
  Synthetic
ccgttttttttttttagttcccc

SEQ ID NO: 15151 - DNA, 23 bp, Artificial Sequence
  Synthetic
ccgttttttttttttagttcccc

SEQ ID NO: 15152 - DNA, 23 bp, Artificial Sequence
  Synthetic
ccgttttttttttttagttcccc

SEQ ID NO: 15153 - DNA, 23 bp, Artificial Sequence
  Synthetic
ccgttttttttttttagtttccc

SEQ ID NO: 15154 - DNA, 23 bp, Artificial Sequence
  Synthetic
ccgttttttttttttatttcccc

SEQ ID NO: 15155 - DNA, 23 bp, Artificial Sequence
  Synthetic
ccgttttttttttttagttccgc

SEQ ID NO: 15156 - DNA, 23 bp, Artificial Sequence
  Synthetic
ccgttttttttttttagaatccc

SEQ ID NO: 15157 - DNA, 23 bp, Artificial Sequence
  Synthetic
ccgttttttttttttagttcaag

SEQ ID NO: 15158 - DNA, 23 bp, Artificial Sequence
  Synthetic
ccgttttttttttttagttcaag

SEQ ID NO: 15159 - DNA, 23 bp, Artificial Sequence
  Synthetic
ccgttttttttttttagttcaag

SEQ ID NO: 15160 - DNA, 23 bp, Artificial Sequence
  Synthetic
ccgttttttttttttagttcaag

SEQ ID NO: 15161 - DNA, 23 bp, Artificial Sequence
  Synthetic
ccgttttttttttttagttcaag

SEQ ID NO: 15162 - DNA, 23 bp, Artificial Sequence
  Synthetic
ccgttttttttttttatcaacgc

SEQ ID NO: 15163 - DNA, 23 bp, Artificial Sequence
  Synthetic
ccgttttttttttttatcaacgc

SEQ ID NO: 15164 - DNA, 23 bp, Artificial Sequence
  Synthetic
ccgttttttttttttaggggtga

SEQ ID NO: 15165 - DNA, 23 bp, Artificial Sequence
  Synthetic
ccgttttttttttttaggggcga

SEQ ID NO: 15166 - DNA, 23 bp, Artificial Sequence
  Synthetic
ccgttttttttttttagggcaat

SEQ ID NO: 15167 - DNA, 23 bp, Artificial Sequence
  Synthetic
ccgttttttttttttagggcaat

SEQ ID NO: 15168 - DNA, 23 bp, Artificial Sequence
  Synthetic
ccgttttttttttttagggcaat

SEQ ID NO: 15169 - DNA, 23 bp, Artificial Sequence
  Synthetic
ccgttttttttttttagggcaac

SEQ ID NO: 15170 - DNA, 23 bp, Artificial Sequence
  Synthetic
ccgttttttttttttgggcaaat

SEQ ID NO: 15171 - DNA, 23 bp, Artificial Sequence
  Synthetic
ccgttttttttttttgggcaaat

SEQ ID NO: 15172 - DNA, 23 bp, Artificial Sequence
  Synthetic
ccgttttttttttttgggcaaat

SEQ ID NO: 15173 - DNA, 23 bp, Artificial Sequence
  Synthetic
ccgttttttttttttgggcaagt

SEQ ID NO: 15174 - DNA, 23 bp, Artificial Sequence
  Synthetic
ccgttttttttttttagggcagc

SEQ ID NO: 15175 - DNA, 23 bp, Artificial Sequence
  Synthetic
ccgttttttttttttgggcaact

SEQ ID NO: 15176 - DNA, 23 bp, Artificial Sequence
  Synthetic
ccgttttttttttttggggcaaa

SEQ ID NO: 15177 - DNA, 23 bp, Artificial Sequence
  Synthetic
ccgttttttttttttccagggaa

SEQ ID NO: 15178 - DNA, 23 bp, Artificial Sequence
  Synthetic
ccgttttttttttttgcagaaca

SEQ ID NO: 15179 - DNA, 23 bp, Artificial Sequence
  Synthetic
ccgttttttttttttgacgatga

SEQ ID NO: 15180 - DNA, 23 bp, Artificial Sequence
  Synthetic
ccgttttttttttttgctctgct

SEQ ID NO: 15181 - DNA, 23 bp, Artificial Sequence
  Synthetic
ccgttttttttttttaacagtgt

SEQ ID NO: 15182 - DNA, 23 bp, Artificial Sequence
  Synthetic
ccgttttttttttttgaacaaat

SEQ ID NO: 15183 - DNA, 23 bp, Artificial Sequence
  Synthetic
ccgttttttttttttgtcatttc

SEQ ID NO: 15184 - DNA, 23 bp, Artificial Sequence
  Synthetic
ccgttttttttttttaacatcgt

SEQ ID NO: 15185 - DNA, 23 bp, Artificial Sequence
  Synthetic
ccgttttttttttttcatttccg

SEQ ID NO: 15186 - DNA, 23 bp, Artificial Sequence
  Synthetic
ccgttttttttttttgtaaggac

SEQ ID NO: 15187 - DNA, 23 bp, Artificial Sequence
  Synthetic
ccgttttttttttttaactccaa

SEQ ID NO: 15188 - DNA, 23 bp, Artificial Sequence
  Synthetic
ccgttttttttttttagtcaaac

SEQ ID NO: 15189 - DNA, 23 bp, Artificial Sequence
  Synthetic
ccgttttttttttttactataac

SEQ ID NO: 15190 - DNA, 23 bp, Artificial Sequence
  Synthetic
ccgttttttttttttgaacaacc

SEQ ID NO: 15191 - DNA, 23 bp, Artificial Sequence
  Synthetic
ccgttttttttttttgaacaacc

SEQ ID NO: 15192 - DNA, 23 bp, Artificial Sequence
  Synthetic
ccgttttttttttttgaacaacc

SEQ ID NO: 15193 - DNA, 23 bp, Artificial Sequence
  Synthetic
ccgttttttttttttgaacaacc

SEQ ID NO: 15194 - DNA, 23 bp, Artificial Sequence
  Synthetic
ccgttttttttttttgaacaacc

SEQ ID NO: 15195 - DNA, 23 bp, Artificial Sequence
  Synthetic
ccgttttttttttttgaacaacc

SEQ ID NO: 15196 - DNA, 23 bp, Artificial Sequence
  Synthetic
ccgttttttttttttgaacaacc

SEQ ID NO: 15197 - DNA, 23 bp, Artificial Sequence
  Synthetic
ccgttttttttttttgaacaacc

SEQ ID NO: 15198 - DNA, 23 bp, Artificial Sequence
  Synthetic
ccgttttttttttttgaacaacc

SEQ ID NO: 15199 - DNA, 23 bp, Artificial Sequence
  Synthetic
ccgttttttttttttgaacaacc

SEQ ID NO: 15200 - DNA, 23 bp, Artificial Sequence
  Synthetic
ccgttttttttttttcccgatca

SEQ ID NO: 15201 - DNA, 23 bp, Artificial Sequence
  Synthetic
ccgttttttttttttccacattt

SEQ ID NO: 15202 - DNA, 23 bp, Artificial Sequence
  Synthetic
ccgttttttttttttccacattt

SEQ ID NO: 15203 - DNA, 23 bp, Artificial Sequence
  Synthetic
ccgttttttttttttccacattt

SEQ ID NO: 15204 - DNA, 23 bp, Artificial Sequence
  Synthetic
ccgttttttttttttcgtctcgc

SEQ ID NO: 15205 - DNA, 23 bp, Artificial Sequence
  Synthetic
ccgttttttttttttcagattta

SEQ ID NO: 15206 - DNA, 23 bp, Artificial Sequence
  Synthetic
ccgttttttttttttcagcaagc

SEQ ID NO: 15207 - DNA, 23 bp, Artificial Sequence
  Synthetic
ccgttttttttttttcggatgtt

SEQ ID NO: 15208 - DNA, 23 bp, Artificial Sequence
  Synthetic
ccgttttttttttttcggatgtt

SEQ ID NO: 15209 - DNA, 23 bp, Artificial Sequence
  Synthetic
ccgttttttttttttcggatgtt

SEQ ID NO: 15210 - DNA, 23 bp, Artificial Sequence
  Synthetic
ccgttttttttttttcggatgtt

SEQ ID NO: 15211 - DNA, 23 bp, Artificial Sequence
  Synthetic
ccgttttttttttttcggatgtt

SEQ ID NO: 15212 - DNA, 23 bp, Artificial Sequence
  Synthetic
ccgttttttttttttcggatgtt

SEQ ID NO: 15213 - DNA, 23 bp, Artificial Sequence
  Synthetic
ccgttttttttttttcggatgtt

SEQ ID NO: 15214 - DNA, 23 bp, Artificial Sequence
  Synthetic
ccgttttttttttttcggatgtt

SEQ ID NO: 15215 - DNA, 23 bp, Artificial Sequence
  Synthetic
ccgttttttttttttcggatgtt

SEQ ID NO: 15216 - DNA, 23 bp, Artificial Sequence
  Synthetic
ccgttttttttttttcatttccc

SEQ ID NO: 15217 - DNA, 23 bp, Artificial Sequence
  Synthetic
ccgttttttttttttcctctgca

SEQ ID NO: 15218 - DNA, 23 bp, Artificial Sequence
  Synthetic
ccgttttttttttttaagaagag

SEQ ID NO: 15219 - DNA, 23 bp, Artificial Sequence
  Synthetic
ccgttttttttttttgcatctgc

SEQ ID NO: 15220 - DNA, 23 bp, Artificial Sequence
  Synthetic
ccgttttttttttttggcggcac

SEQ ID NO: 15221 - DNA, 23 bp, Artificial Sequence
  Synthetic
ccgttttttttttttcgtgctct

SEQ ID NO: 15222 - DNA, 23 bp, Artificial Sequence
  Synthetic
ccgttttttttttttaccgttga

SEQ ID NO: 15223 - DNA, 23 bp, Artificial Sequence
  Synthetic
ccgttttttttttttaccgttga

SEQ ID NO: 15224 - DNA, 23 bp, Artificial Sequence
  Synthetic
ccgttttttttttttaccgttga

SEQ ID NO: 15225 - DNA, 23 bp, Artificial Sequence
  Synthetic
ccgttttttttttttaccgttga

SEQ ID NO: 15226 - DNA, 23 bp, Artificial Sequence
  Synthetic
ccgttttttttttttaccgttga

SEQ ID NO: 15227 - DNA, 23 bp, Artificial Sequence
  Synthetic
ccgttttttttttttaccgttga

SEQ ID NO: 15228 - DNA, 23 bp, Artificial Sequence
  Synthetic
ccgttttttttttttaccgttga

SEQ ID NO: 15229 - DNA, 23 bp, Artificial Sequence
  Synthetic
ccgttttttttttttaccgttga

SEQ ID NO: 15230 - DNA, 23 bp, Artificial Sequence
  Synthetic
ccgttttttttttttgattcacc

SEQ ID NO: 15231 - DNA, 23 bp, Artificial Sequence
  Synthetic
ccgttttttttttttgattcacc

SEQ ID NO: 15232 - DNA, 23 bp, Artificial Sequence
  Synthetic
ccgttttttttttttgattcacc

SEQ ID NO: 15233 - DNA, 23 bp, Artificial Sequence
  Synthetic
ccgttttttttttttacatttcc

SEQ ID NO: 15234 - DNA, 23 bp, Artificial Sequence
  Synthetic
ccgttttttttttttctaacatt

SEQ ID NO: 15235 - DNA, 23 bp, Artificial Sequence
  Synthetic
ccgttttttttttttctaacatt

SEQ ID NO: 15236 - DNA, 23 bp, Artificial Sequence
  Synthetic
ccgttttttttttttctaacatt

SEQ ID NO: 15237 - DNA, 23 bp, Artificial Sequence
  Synthetic
ccgttttttttttttctaacatt

SEQ ID NO: 15238 - DNA, 23 bp, Artificial Sequence
  Synthetic
ccgttttttttttttctaacatt

SEQ ID NO: 15239 - DNA, 23 bp, Artificial Sequence
  Synthetic
ccgttttttttttttctaacatt

SEQ ID NO: 15240 - DNA, 23 bp, Artificial Sequence
  Synthetic
ccgttttttttttttctaacatt

SEQ ID NO: 15241 - DNA, 23 bp, Artificial Sequence
  Synthetic
ccgttttttttttttctaacatt

SEQ ID NO: 15242 - DNA, 23 bp, Artificial Sequence
  Synthetic
ccgttttttttttttcacatgtg

SEQ ID NO: 15243 - DNA, 23 bp, Artificial Sequence
  Synthetic
ccgttttttttttttcgtccatt

SEQ ID NO: 15244 - DNA, 23 bp, Artificial Sequence
  Synthetic
ccgttttttttttttcgtccatt

SEQ ID NO: 15245 - DNA, 23 bp, Artificial Sequence
  Synthetic
ccgttttttttttttcgtccatt

SEQ ID NO: 15246 - DNA, 23 bp, Artificial Sequence
  Synthetic
ccgttttttttttttccaacgtt

SEQ ID NO: 15247 - DNA, 23 bp, Artificial Sequence
  Synthetic
ccgttttttttttttccaacgtt

SEQ ID NO: 15248 - DNA, 23 bp, Artificial Sequence
  Synthetic
ccgttttttttttttccaacgtt

SEQ ID NO: 15249 - DNA, 23 bp, Artificial Sequence
  Synthetic
ccgttttttttttttccaacgtt

SEQ ID NO: 15250 - DNA, 23 bp, Artificial Sequence
  Synthetic
ccgttttttttttttccaacgtt

SEQ ID NO: 15251 - DNA, 23 bp, Artificial Sequence
  Synthetic
ccgttttttttttttgtaaaacc

SEQ ID NO: 15252 - DNA, 23 bp, Artificial Sequence
  Synthetic
ccgttttttttttttgattcgtt

SEQ ID NO: 15253 - DNA, 23 bp, Artificial Sequence
  Synthetic
ccgttttttttttttgattcgtt

SEQ ID NO: 15254 - DNA, 23 bp, Artificial Sequence
  Synthetic
ccgttttttttttttgattcgtt

SEQ ID NO: 15255 - DNA, 23 bp, Artificial Sequence
  Synthetic
ccgttttttttttttccaatctc

SEQ ID NO: 15256 - DNA, 23 bp, Artificial Sequence
  Synthetic
ccgttttttttttttccaatctc

SEQ ID NO: 15257 - DNA, 23 bp, Artificial Sequence
  Synthetic
ccgttttttttttttccaatctc

SEQ ID NO: 15258 - DNA, 23 bp, Artificial Sequence
  Synthetic
ccgttttttttttttgtagtaaa

SEQ ID NO: 15259 - DNA, 23 bp, Artificial Sequence
  Synthetic
ccgttttttttttttaatcgggc

SEQ ID NO: 15260 - DNA, 23 bp, Artificial Sequence
  Synthetic
ccgttttttttttttcgtcccat

SEQ ID NO: 15261 - DNA, 23 bp, Artificial Sequence
  Synthetic
ccgttttttttttttcgtcccat

SEQ ID NO: 15262 - DNA, 23 bp, Artificial Sequence
  Synthetic
ccgttttttttttttcgtcccat

SEQ ID NO: 15263 - DNA, 23 bp, Artificial Sequence
  Synthetic
ccgttttttttttttcgtcccat

SEQ ID NO: 15264 - DNA, 23 bp, Artificial Sequence
  Synthetic
ccgttttttttttttcgtcccat

SEQ ID NO: 15265 - DNA, 23 bp, Artificial Sequence
  Synthetic
ccgttttttttttttctagaaag

SEQ ID NO: 15266 - DNA, 23 bp, Artificial Sequence
  Synthetic
ccgttttttttttttctagaaag

SEQ ID NO: 15267 - DNA, 23 bp, Artificial Sequence
  Synthetic
ccgttttttttttttctagaaag

SEQ ID NO: 15268 - DNA, 23 bp, Artificial Sequence
  Synthetic
ccgttttttttttttctagaaag

SEQ ID NO: 15269 - DNA, 23 bp, Artificial Sequence
  Synthetic
ccgttttttttttttctagaaag

SEQ ID NO: 15270 - DNA, 23 bp, Artificial Sequence
  Synthetic
ccgttttttttttttctagaaag

SEQ ID NO: 15271 - DNA, 23 bp, Artificial Sequence
  Synthetic
ccgttttttttttttctagaaag

SEQ ID NO: 15272 - DNA, 23 bp, Artificial Sequence
  Synthetic
ccgttttttttttttctagaaag

SEQ ID NO: 15273 - DNA, 23 bp, Artificial Sequence
  Synthetic
ccgttttttttttttctagaaag

SEQ ID NO: 15274 - DNA, 23 bp, Artificial Sequence
  Synthetic
ccgttttttttttttctagaaag

SEQ ID NO: 15275 - DNA, 23 bp, Artificial Sequence
  Synthetic
ccgttttttttttttctagaaag

SEQ ID NO: 15276 - DNA, 23 bp, Artificial Sequence
  Synthetic
ccgttttttttttttctggtcca

SEQ ID NO: 15277 - DNA, 23 bp, Artificial Sequence
  Synthetic
ccgttttttttttttctggtcca

SEQ ID NO: 15278 - DNA, 23 bp, Artificial Sequence
  Synthetic
ccgttttttttttttctggtcca

SEQ ID NO: 15279 - DNA, 23 bp, Artificial Sequence
  Synthetic
ccgttttttttttttcaactttt

SEQ ID NO: 15280 - DNA, 23 bp, Artificial Sequence
  Synthetic
ccgttttttttttttcaactttt

SEQ ID NO: 15281 - DNA, 23 bp, Artificial Sequence
  Synthetic
ccgttttttttttttcaactttt

SEQ ID NO: 15282 - DNA, 23 bp, Artificial Sequence
  Synthetic
ccgttttttttttttcatacttc

SEQ ID NO: 15283 - DNA, 23 bp, Artificial Sequence
  Synthetic
ccgttttttttttttacaagttc

SEQ ID NO: 15284 - DNA, 23 bp, Artificial Sequence
  Synthetic
ccgttttttttttttcagttatc

SEQ ID NO: 15285 - DNA, 23 bp, Artificial Sequence
  Synthetic
ccgttttttttttttatagccct

SEQ ID NO: 15286 - DNA, 23 bp, Artificial Sequence
  Synthetic
ccgttttttttttttcaggagtc

SEQ ID NO: 15287 - DNA, 23 bp, Artificial Sequence
  Synthetic
ccgttttttttttttctacctgc

SEQ ID NO: 15288 - DNA, 23 bp, Artificial Sequence
  Synthetic
ccgttttttttttttctgcactg

SEQ ID NO: 15289 - DNA, 23 bp, Artificial Sequence
  Synthetic
ccgttttttttttttatagccct

SEQ ID NO: 15290 - DNA, 23 bp, Artificial Sequence
  Synthetic
ccgttttttttttttacaaattc

SEQ ID NO: 15291 - DNA, 23 bp, Artificial Sequence
  Synthetic
ccgttttttttttttcaaattcg

SEQ ID NO: 15292 - DNA, 23 bp, Artificial Sequence
  Synthetic
ccgttttttttttttgcattcac

SEQ ID NO: 15293 - DNA, 23 bp, Artificial Sequence
  Synthetic
ccgttttttttttttacaagtta

SEQ ID NO: 15294 - DNA, 23 bp, Artificial Sequence
  Synthetic
ccgttttttttttttaaagagac

SEQ ID NO: 15295 - DNA, 23 bp, Artificial Sequence
  Synthetic
ccgttttttttttttccctttta

SEQ ID NO: 15296 - DNA, 23 bp, Artificial Sequence
  Synthetic
ccgttttttttttttcagctggt

SEQ ID NO: 15297 - DNA, 23 bp, Artificial Sequence
  Synthetic
ccgttttttttttttcctctggt

SEQ ID NO: 15298 - DNA, 23 bp, Artificial Sequence
  Synthetic
ccgttttttttttttacatagga

SEQ ID NO: 15299 - DNA, 23 bp, Artificial Sequence
  Synthetic
ccgttttttttttttcatcatca

SEQ ID NO: 15300 - DNA, 23 bp, Artificial Sequence
  Synthetic
ccgttttttttttttgacacgtg

SEQ ID NO: 15301 - DNA, 23 bp, Artificial Sequence
  Synthetic
ccgttttttttttttcatcttta

SEQ ID NO: 15302 - DNA, 23 bp, Artificial Sequence
  Synthetic
ccgttttttttttttagctacag

SEQ ID NO: 15303 - DNA, 23 bp, Artificial Sequence
  Synthetic
ccgttttttttttttagtacatc

SEQ ID NO: 15304 - DNA, 23 bp, Artificial Sequence
  Synthetic
ccgttttttttttttcagaagca

SEQ ID NO: 15305 - DNA, 23 bp, Artificial Sequence
  Synthetic
ccgttttttttttttgaaggcaa

SEQ ID NO: 15306 - DNA, 23 bp, Artificial Sequence
  Synthetic
ccgttttttttttttacaaacca

SEQ ID NO: 15307 - DNA, 23 bp, Artificial Sequence
  Synthetic
ccgttttttttttttaaaccatg

SEQ ID NO: 15308 - DNA, 23 bp, Artificial Sequence
  Synthetic
ccgttttttttttttgccaatat

SEQ ID NO: 15309 - DNA, 23 bp, Artificial Sequence
  Synthetic
ccgttttttttttttcaagtgcc

SEQ ID NO: 15310 - DNA, 23 bp, Artificial Sequence
  Synthetic
ccgttttttttttttctacctgc

SEQ ID NO: 15311 - DNA, 23 bp, Artificial Sequence
  Synthetic
ccgttttttttttttctgcacta

SEQ ID NO: 15312 - DNA, 23 bp, Artificial Sequence
  Synthetic
ccgttttttttttttctcaccga

SEQ ID NO: 15313 - DNA, 23 bp, Artificial Sequence
  Synthetic
ccgttttttttttttgtacaatc

SEQ ID NO: 15314 - DNA, 23 bp, Artificial Sequence
  Synthetic
ccgttttttttttttacccaccg

SEQ ID NO: 15315 - DNA, 23 bp, Artificial Sequence
  Synthetic
ccgttttttttttttctcaccga

SEQ ID NO: 15316 - DNA, 23 bp, Artificial Sequence
  Synthetic
ccgttttttttttttagtgaatt

SEQ ID NO: 15317 - DNA, 23 bp, Artificial Sequence
  Synthetic
ccgttttttttttttagcccaaa

SEQ ID NO: 15318 - DNA, 23 bp, Artificial Sequence
  Synthetic
ccgttttttttttttggctgcaa

SEQ ID NO: 15319 - DNA, 23 bp, Artificial Sequence
  Synthetic
ccgttttttttttttccctccac

SEQ ID NO: 15320 - DNA, 23 bp, Artificial Sequence
  Synthetic
ccgttttttttttttctgatatc

SEQ ID NO: 15321 - DNA, 23 bp, Artificial Sequence
  Synthetic
ccgttttttttttttcctaatat

SEQ ID NO: 15322 - DNA, 23 bp, Artificial Sequence
  Synthetic
ccgttttttttttttccaatatt

SEQ ID NO: 15323 - DNA, 23 bp, Artificial Sequence
  Synthetic
ccgttttttttttttccaacaac

SEQ ID NO: 15324 - DNA, 23 bp, Artificial Sequence
  Synthetic
ccgttttttttttttctgggtgg

SEQ ID NO: 15325 - DNA, 23 bp, Artificial Sequence
  Synthetic
ccgttttttttttttctatctcc

SEQ ID NO: 15326 - DNA, 23 bp, Artificial Sequence
  Synthetic
ccgttttttttttttaacaggta

SEQ ID NO: 15327 - DNA, 23 bp, Artificial Sequence
  Synthetic
ccgttttttttttttagttttgc

SEQ ID NO: 15328 - DNA, 23 bp, Artificial Sequence
  Synthetic
ccgttttttttttttagttttgc

SEQ ID NO: 15329 - DNA, 23 bp, Artificial Sequence
  Synthetic
ccgttttttttttttcctgcact

SEQ ID NO: 15330 - DNA, 23 bp, Artificial Sequence
  Synthetic
ccgttttttttttttggcatagg

SEQ ID NO: 15331 - DNA, 23 bp, Artificial Sequence
  Synthetic
ccgttttttttttttagactccg

SEQ ID NO: 15332 - DNA, 23 bp, Artificial Sequence
  Synthetic
ccgttttttttttttaacatcag

SEQ ID NO: 15333 - DNA, 23 bp, Artificial Sequence
  Synthetic
ccgttttttttttttgcctgtct

SEQ ID NO: 15334 - DNA, 23 bp, Artificial Sequence
  Synthetic
ccgttttttttttttacagttgc

SEQ ID NO: 15335 - DNA, 23 bp, Artificial Sequence
  Synthetic
ccgttttttttttttccaatcag

SEQ ID NO: 15336 - DNA, 23 bp, Artificial Sequence
  Synthetic
ccgttttttttttttcatggtta

SEQ ID NO: 15337 - DNA, 23 bp, Artificial Sequence
  Synthetic
ccgttttttttttttcagttctt

SEQ ID NO: 15338 - DNA, 23 bp, Artificial Sequence
  Synthetic
ccgttttttttttttaagtgtca

SEQ ID NO: 15339 - DNA, 23 bp, Artificial Sequence
  Synthetic
ccgttttttttttttaaacccag

SEQ ID NO: 15340 - DNA, 23 bp, Artificial Sequence
  Synthetic
ccgttttttttttttgggtattt

SEQ ID NO: 15341 - DNA, 23 bp, Artificial Sequence
  Synthetic
ccgttttttttttttaacggaac

SEQ ID NO: 15342 - DNA, 23 bp, Artificial Sequence
  Synthetic
ccgttttttttttttgaaatccc

SEQ ID NO: 15343 - DNA, 23 bp, Artificial Sequence
  Synthetic
ccgttttttttttttggtaatcc

SEQ ID NO: 15344 - DNA, 23 bp, Artificial Sequence
  Synthetic
ccgttttttttttttgttcctgc

SEQ ID NO: 15345 - DNA, 23 bp, Artificial Sequence
  Synthetic
ccgttttttttttttagaccgag

SEQ ID NO: 15346 - DNA, 23 bp, Artificial Sequence
  Synthetic
ccgttttttttttttgcctatcc

SEQ ID NO: 15347 - DNA, 23 bp, Artificial Sequence
  Synthetic
ccgttttttttttttgcggaact

SEQ ID NO: 15348 - DNA, 23 bp, Artificial Sequence
  Synthetic
ccgttttttttttttcaatagac

SEQ ID NO: 15349 - DNA, 23 bp, Artificial Sequence
  Synthetic
ccgttttttttttttaccgattt

SEQ ID NO: 15350 - DNA, 23 bp, Artificial Sequence
  Synthetic
ccgttttttttttttctgatttc

SEQ ID NO: 15351 - DNA, 23 bp, Artificial Sequence
  Synthetic
ccgttttttttttttctgcaaac

SEQ ID NO: 15352 - DNA, 23 bp, Artificial Sequence
  Synthetic
ccgttttttttttttccagtcga

SEQ ID NO: 15353 - DNA, 23 bp, Artificial Sequence
  Synthetic
ccgttttttttttttctgagtgt

SEQ ID NO: 15354 - DNA, 23 bp, Artificial Sequence
  Synthetic
ccgttttttttttttccagtcgg

SEQ ID NO: 15355 - DNA, 23 bp, Artificial Sequence
  Synthetic
ccgttttttttttttagctatgc

SEQ ID NO: 15356 - DNA, 23 bp, Artificial Sequence
  Synthetic
ccgttttttttttttcaacttag

SEQ ID NO: 15357 - DNA, 23 bp, Artificial Sequence
  Synthetic
ccgttttttttttttaatgcaac

SEQ ID NO: 15358 - DNA, 23 bp, Artificial Sequence
  Synthetic
ccgttttttttttttcaaccagc

SEQ ID NO: 15359 - DNA, 23 bp, Artificial Sequence
  Synthetic
ccgttttttttttttacaaaatc

SEQ ID NO: 15360 - DNA, 23 bp, Artificial Sequence
  Synthetic
ccgttttttttttttcaggccgg

SEQ ID NO: 15361 - DNA, 23 bp, Artificial Sequence
  Synthetic
ccgttttttttttttacctgcac

SEQ ID NO: 15362 - DNA, 23 bp, Artificial Sequence
  Synthetic
ccgttttttttttttctcaataa

SEQ ID NO: 15363 - DNA, 23 bp, Artificial Sequence
  Synthetic
ccgttttttttttttcaaaaatg

SEQ ID NO: 15364 - DNA, 23 bp, Artificial Sequence
  Synthetic
ccgttttttttttttacaataca

SEQ ID NO: 15365 - DNA, 23 bp, Artificial Sequence
  Synthetic
ccgttttttttttttacaagatc

SEQ ID NO: 15366 - DNA, 23 bp, Artificial Sequence
  Synthetic
ccgttttttttttttctctccca

SEQ ID NO: 15367 - DNA, 23 bp, Artificial Sequence
  Synthetic
ccgttttttttttttgcataacc

SEQ ID NO: 15368 - DNA, 23 bp, Artificial Sequence
  Synthetic
ccgttttttttttttgcattcta

SEQ ID NO: 15369 - DNA, 23 bp, Artificial Sequence
  Synthetic
ccgttttttttttttcccacgaa

SEQ ID NO: 15370 - DNA, 23 bp, Artificial Sequence
  Synthetic
ccgttttttttttttgccgcgag

SEQ ID NO: 15371 - DNA, 23 bp, Artificial Sequence
  Synthetic
ccgttttttttttttgtatacag

SEQ ID NO: 15372 - DNA, 23 bp, Artificial Sequence
  Synthetic
ccgttttttttttttatacaagc

SEQ ID NO: 15373 - DNA, 23 bp, Artificial Sequence
  Synthetic
ccgttttttttttttgacatcat

SEQ ID NO: 15374 - DNA, 23 bp, Artificial Sequence
  Synthetic
ccgttttttttttttagaggcct

SEQ ID NO: 15375 - DNA, 23 bp, Artificial Sequence
  Synthetic
ccgttttttttttttagctagtg

SEQ ID NO: 15376 - DNA, 23 bp, Artificial Sequence
  Synthetic
ccgttttttttttttagctagtg

SEQ ID NO: 15377 - DNA, 23 bp, Artificial Sequence
  Synthetic
ccgttttttttttttagctagtg

SEQ ID NO: 15378 - DNA, 23 bp, Artificial Sequence
  Synthetic
ccgttttttttttttagctagtg

SEQ ID NO: 15379 - DNA, 23 bp, Artificial Sequence
  Synthetic
ccgttttttttttttgaactcct

SEQ ID NO: 15380 - DNA, 23 bp, Artificial Sequence
  Synthetic
ccgttttttttttttgaactcct

SEQ ID NO: 15381 - DNA, 23 bp, Artificial Sequence
  Synthetic
ccgttttttttttttaccctgca

SEQ ID NO: 15382 - DNA, 23 bp, Artificial Sequence
  Synthetic
ccgttttttttttttaccaatga

SEQ ID NO: 15383 - DNA, 23 bp, Artificial Sequence
  Synthetic
ccgttttttttttttgaggtgta

SEQ ID NO: 15384 - DNA, 23 bp, Artificial Sequence
  Synthetic
ccgttttttttttttgctcactc

SEQ ID NO: 15385 - DNA, 23 bp, Artificial Sequence
  Synthetic
ccgttttttttttttgagctccc

SEQ ID NO: 15386 - DNA, 23 bp, Artificial Sequence
  Synthetic
ccgttttttttttttgagctccc

SEQ ID NO: 15387 - DNA, 23 bp, Artificial Sequence
  Synthetic
ccgttttttttttttggagctcc

SEQ ID NO: 15388 - DNA, 23 bp, Artificial Sequence
  Synthetic
ccgttttttttttttggagctcc

SEQ ID NO: 15389 - DNA, 23 bp, Artificial Sequence
  Synthetic
ccgttttttttttttgcgctatc

SEQ ID NO: 15390 - DNA, 23 bp, Artificial Sequence
  Synthetic
ccgttttttttttttgcgctatc

SEQ ID NO: 15391 - DNA, 23 bp, Artificial Sequence
  Synthetic
ccgttttttttttttgcgctatc

SEQ ID NO: 15392 - DNA, 23 bp, Artificial Sequence
  Synthetic
ccgttttttttttttcctcacag

SEQ ID NO: 15393 - DNA, 23 bp, Artificial Sequence
  Synthetic
ccgttttttttttttcctcacag

SEQ ID NO: 15394 - DNA, 23 bp, Artificial Sequence
  Synthetic
ccgttttttttttttatgcaact

SEQ ID NO: 15395 - DNA, 23 bp, Artificial Sequence
  Synthetic
ccgttttttttttttcgtgctct

SEQ ID NO: 15396 - DNA, 23 bp, Artificial Sequence
  Synthetic
ccgttttttttttttcgtgctct

SEQ ID NO: 15397 - DNA, 23 bp, Artificial Sequence
  Synthetic
ccgttttttttttttcgtgctct

SEQ ID NO: 15398 - DNA, 23 bp, Artificial Sequence
  Synthetic
ccgttttttttttttgcgtgctc

SEQ ID NO: 15399 - DNA, 23 bp, Artificial Sequence
  Synthetic
ccgttttttttttttgcacacag

SEQ ID NO: 15400 - DNA, 23 bp, Artificial Sequence
  Synthetic
ccgttttttttttttgcctgtag

SEQ ID NO: 15401 - DNA, 23 bp, Artificial Sequence
  Synthetic
ccgttttttttttttgcctgtag

SEQ ID NO: 15402 - DNA, 23 bp, Artificial Sequence
  Synthetic
ccgttttttttttttcagacata

SEQ ID NO: 15403 - DNA, 23 bp, Artificial Sequence
  Synthetic
ccgttttttttttttcagacata

SEQ ID NO: 15404 - DNA, 23 bp, Artificial Sequence
  Synthetic
ccgttttttttttttcagacata

SEQ ID NO: 15405 - DNA, 23 bp, Artificial Sequence
  Synthetic
ccgttttttttttttacaagttc

SEQ ID NO: 15406 - DNA, 23 bp, Artificial Sequence
  Synthetic
ccgttttttttttttcagttatc

SEQ ID NO: 15407 - DNA, 23 bp, Artificial Sequence
  Synthetic
ccgttttttttttttatagccct

SEQ ID NO: 15408 - DNA, 23 bp, Artificial Sequence
  Synthetic
ccgttttttttttttcaggagtc

SEQ ID NO: 15409 - DNA, 23 bp, Artificial Sequence
  Synthetic
ccgttttttttttttctacctgc

SEQ ID NO: 15410 - DNA, 23 bp, Artificial Sequence
  Synthetic
ccgttttttttttttctgcactg

SEQ ID NO: 15411 - DNA, 23 bp, Artificial Sequence
  Synthetic
ccgttttttttttttatagccct

SEQ ID NO: 15412 - DNA, 23 bp, Artificial Sequence
  Synthetic
ccgttttttttttttacaaattc

SEQ ID NO: 15413 - DNA, 23 bp, Artificial Sequence
  Synthetic
ccgttttttttttttgcattcac

SEQ ID NO: 15414 - DNA, 23 bp, Artificial Sequence
  Synthetic
ccgttttttttttttacaagtta

SEQ ID NO: 15415 - DNA, 23 bp, Artificial Sequence
  Synthetic
ccgttttttttttttgccaagct

SEQ ID NO: 15416 - DNA, 23 bp, Artificial Sequence
  Synthetic
ccgttttttttttttaaagagac

SEQ ID NO: 15417 - DNA, 23 bp, Artificial Sequence
  Synthetic
ccgttttttttttttcagctggt

SEQ ID NO: 15418 - DNA, 23 bp, Artificial Sequence
  Synthetic
ccgttttttttttttcctctggt

SEQ ID NO: 15419 - DNA, 23 bp, Artificial Sequence
  Synthetic
ccgttttttttttttacatagga

SEQ ID NO: 15420 - DNA, 23 bp, Artificial Sequence
  Synthetic
ccgttttttttttttcatcatca

SEQ ID NO: 15421 - DNA, 23 bp, Artificial Sequence
  Synthetic
ccgttttttttttttcatcttta

SEQ ID NO: 15422 - DNA, 23 bp, Artificial Sequence
  Synthetic
ccgttttttttttttagctacag

SEQ ID NO: 15423 - DNA, 23 bp, Artificial Sequence
  Synthetic
ccgttttttttttttagtacatc

SEQ ID NO: 15424 - DNA, 23 bp, Artificial Sequence
  Synthetic
ccgttttttttttttagggattc

SEQ ID NO: 15425 - DNA, 23 bp, Artificial Sequence
  Synthetic
ccgttttttttttttcagaagca

SEQ ID NO: 15426 - DNA, 23 bp, Artificial Sequence
  Synthetic
ccgttttttttttttacttttgt

SEQ ID NO: 15427 - DNA, 23 bp, Artificial Sequence
  Synthetic
ccgttttttttttttgaaggcaa

SEQ ID NO: 15428 - DNA, 23 bp, Artificial Sequence
  Synthetic
ccgttttttttttttacaaacca

SEQ ID NO: 15429 - DNA, 23 bp, Artificial Sequence
  Synthetic
ccgttttttttttttaaaccatg

SEQ ID NO: 15430 - DNA, 23 bp, Artificial Sequence
  Synthetic
ccgttttttttttttgccaatat

SEQ ID NO: 15431 - DNA, 23 bp, Artificial Sequence
  Synthetic
ccgttttttttttttcaagtgcc

SEQ ID NO: 15432 - DNA, 23 bp, Artificial Sequence
  Synthetic
ccgttttttttttttctacctgc

SEQ ID NO: 15433 - DNA, 23 bp, Artificial Sequence
  Synthetic
ccgttttttttttttctgcacta

SEQ ID NO: 15434 - DNA, 23 bp, Artificial Sequence
  Synthetic
ccgttttttttttttctcaccga

SEQ ID NO: 15435 - DNA, 23 bp, Artificial Sequence
  Synthetic
ccgttttttttttttgtacaatc

SEQ ID NO: 15436 - DNA, 23 bp, Artificial Sequence
  Synthetic
ccgttttttttttttacccaccg

SEQ ID NO: 15437 - DNA, 23 bp, Artificial Sequence
  Synthetic
ccgttttttttttttgagttcta

SEQ ID NO: 15438 - DNA, 23 bp, Artificial Sequence
  Synthetic
ccgttttttttttttcccttatc

SEQ ID NO: 15439 - DNA, 23 bp, Artificial Sequence
  Synthetic
ccgttttttttttttggctgcaa

SEQ ID NO: 15440 - DNA, 23 bp, Artificial Sequence
  Synthetic
ccgttttttttttttccctccac

SEQ ID NO: 15441 - DNA, 23 bp, Artificial Sequence
  Synthetic
ccgttttttttttttctgatatc

SEQ ID NO: 15442 - DNA, 23 bp, Artificial Sequence
  Synthetic
ccgttttttttttttcacatgga

SEQ ID NO: 15443 - DNA, 23 bp, Artificial Sequence
  Synthetic
ccgttttttttttttcaacaaca

SEQ ID NO: 15444 - DNA, 23 bp, Artificial Sequence
  Synthetic
ccgttttttttttttccaacaac

SEQ ID NO: 15445 - DNA, 23 bp, Artificial Sequence
  Synthetic
ccgttttttttttttctgggtgg

SEQ ID NO: 15446 - DNA, 23 bp, Artificial Sequence
  Synthetic
ccgttttttttttttctatctcc

SEQ ID NO: 15447 - DNA, 23 bp, Artificial Sequence
  Synthetic
ccgttttttttttttaacaggta

SEQ ID NO: 15448 - DNA, 23 bp, Artificial Sequence
  Synthetic
ccgttttttttttttagttttgc

SEQ ID NO: 15449 - DNA, 23 bp, Artificial Sequence
  Synthetic
ccgttttttttttttagttttgc

SEQ ID NO: 15450 - DNA, 23 bp, Artificial Sequence
  Synthetic
ccgttttttttttttcctgcact

SEQ ID NO: 15451 - DNA, 23 bp, Artificial Sequence
  Synthetic
ccgttttttttttttcatcatta

SEQ ID NO: 15452 - DNA, 23 bp, Artificial Sequence
  Synthetic
ccgttttttttttttggcatagg

SEQ ID NO: 15453 - DNA, 23 bp, Artificial Sequence
  Synthetic
ccgttttttttttttcacacact

SEQ ID NO: 15454 - DNA, 23 bp, Artificial Sequence
  Synthetic
ccgttttttttttttaacatcag

SEQ ID NO: 15455 - DNA, 23 bp, Artificial Sequence
  Synthetic
ccgttttttttttttggcgaagg

SEQ ID NO: 15456 - DNA, 23 bp, Artificial Sequence
  Synthetic
ccgttttttttttttgcctgtct

SEQ ID NO: 15457 - DNA, 23 bp, Artificial Sequence
  Synthetic
ccgttttttttttttctgtcaat

SEQ ID NO: 15458 - DNA, 23 bp, Artificial Sequence
  Synthetic
ccgttttttttttttacagttgc

SEQ ID NO: 15459 - DNA, 23 bp, Artificial Sequence
  Synthetic
ccgttttttttttttcatggtta

SEQ ID NO: 15460 - DNA, 23 bp, Artificial Sequence
  Synthetic
ccgttttttttttttgaattgcg

SEQ ID NO: 15461 - DNA, 23 bp, Artificial Sequence
  Synthetic
ccgttttttttttttcagttctt

SEQ ID NO: 15462 - DNA, 23 bp, Artificial Sequence
  Synthetic
ccgttttttttttttaaacccag

SEQ ID NO: 15463 - DNA, 23 bp, Artificial Sequence
  Synthetic
ccgttttttttttttgggtattt

SEQ ID NO: 15464 - DNA, 23 bp, Artificial Sequence
  Synthetic
ccgttttttttttttaacggaac

SEQ ID NO: 15465 - DNA, 23 bp, Artificial Sequence
  Synthetic
ccgttttttttttttgaaatccc

SEQ ID NO: 15466 - DNA, 23 bp, Artificial Sequence
  Synthetic
ccgttttttttttttggtaatcc

SEQ ID NO: 15467 - DNA, 23 bp, Artificial Sequence
  Synthetic
ccgttttttttttttgttcctgc

SEQ ID NO: 15468 - DNA, 23 bp, Artificial Sequence
  Synthetic
ccgttttttttttttagaccgag

SEQ ID NO: 15469 - DNA, 23 bp, Artificial Sequence
  Synthetic
ccgttttttttttttgcctatcc

SEQ ID NO: 15470 - DNA, 23 bp, Artificial Sequence
  Synthetic
ccgttttttttttttgcggaact

SEQ ID NO: 15471 - DNA, 23 bp, Artificial Sequence
  Synthetic
ccgttttttttttttcaatagac

SEQ ID NO: 15472 - DNA, 23 bp, Artificial Sequence
  Synthetic
ccgttttttttttttaccgattt

SEQ ID NO: 15473 - DNA, 23 bp, Artificial Sequence
  Synthetic
ccgttttttttttttctgatttc

SEQ ID NO: 15474 - DNA, 23 bp, Artificial Sequence
  Synthetic
ccgttttttttttttctgcaaac

SEQ ID NO: 15475 - DNA, 23 bp, Artificial Sequence
  Synthetic
ccgttttttttttttccagtcga

SEQ ID NO: 15476 - DNA, 23 bp, Artificial Sequence
  Synthetic
ccgttttttttttttagctatgc

SEQ ID NO: 15477 - DNA, 23 bp, Artificial Sequence
  Synthetic
ccgttttttttttttcaacttag

SEQ ID NO: 15478 - DNA, 23 bp, Artificial Sequence
  Synthetic
ccgttttttttttttaatgcaac

SEQ ID NO: 15479 - DNA, 23 bp, Artificial Sequence
  Synthetic
ccgttttttttttttcaaccagc

SEQ ID NO: 15480 - DNA, 23 bp, Artificial Sequence
  Synthetic
ccgttttttttttttacaaaatc

SEQ ID NO: 15481 - DNA, 23 bp, Artificial Sequence
  Synthetic
ccgttttttttttttcaggccgg

SEQ ID NO: 15482 - DNA, 23 bp, Artificial Sequence
  Synthetic
ccgttttttttttttacctgcac

SEQ ID NO: 15483 - DNA, 23 bp, Artificial Sequence
  Synthetic
ccgttttttttttttctcaataa

SEQ ID NO: 15484 - DNA, 23 bp, Artificial Sequence
  Synthetic
ccgttttttttttttacaataca

SEQ ID NO: 15485 - DNA, 23 bp, Artificial Sequence
  Synthetic
ccgttttttttttttacaagatc

SEQ ID NO: 15486 - DNA, 23 bp, Artificial Sequence
  Synthetic
ccgttttttttttttgctcactc

SEQ ID NO: 15487 - DNA, 23 bp, Artificial Sequence
  Synthetic
ccgttttttttttttgctcactc

SEQ ID NO: 15488 - DNA, 23 bp, Artificial Sequence
  Synthetic
ccgttttttttttttgctcactc

SEQ ID NO: 15489 - DNA, 23 bp, Artificial Sequence
  Synthetic
ccgttttttttttttgctcactc

SEQ ID NO: 15490 - DNA, 23 bp, Artificial Sequence
  Synthetic
ccgttttttttttttgctcactc

SEQ ID NO: 15491 - DNA, 23 bp, Artificial Sequence
  Synthetic
ccgttttttttttttgctcactc

SEQ ID NO: 15492 - DNA, 23 bp, Artificial Sequence
  Synthetic
ccgttttttttttttgctctcta

SEQ ID NO: 15493 - DNA, 23 bp, Artificial Sequence
  Synthetic
ccgttttttttttttgctctcta

SEQ ID NO: 15494 - DNA, 23 bp, Artificial Sequence
  Synthetic
ccgttttttttttttgctctcta

SEQ ID NO: 15495 - DNA, 23 bp, Artificial Sequence
  Synthetic
ccgttttttttttttgctctcta

SEQ ID NO: 15496 - DNA, 23 bp, Artificial Sequence
  Synthetic
ccgttttttttttttgctccctc

SEQ ID NO: 15497 - DNA, 23 bp, Artificial Sequence
  Synthetic
ccgttttttttttttgagctccc

SEQ ID NO: 15498 - DNA, 23 bp, Artificial Sequence
  Synthetic
ccgttttttttttttgagctccc

SEQ ID NO: 15499 - DNA, 23 bp, Artificial Sequence
  Synthetic
ccgttttttttttttgagctccc

SEQ ID NO: 15500 - DNA, 23 bp, Artificial Sequence
  Synthetic
ccgttttttttttttggagctcc

SEQ ID NO: 15501 - DNA, 23 bp, Artificial Sequence
  Synthetic
ccgttttttttttttggagctcc

SEQ ID NO: 15502 - DNA, 23 bp, Artificial Sequence
  Synthetic
ccgttttttttttttgagctccc

SEQ ID NO: 15503 - DNA, 23 bp, Artificial Sequence
  Synthetic
ccgttttttttttttgcatacag

SEQ ID NO: 15504 - DNA, 23 bp, Artificial Sequence
  Synthetic
ccgttttttttttttgcatacag

SEQ ID NO: 15505 - DNA, 23 bp, Artificial Sequence
  Synthetic
ccgttttttttttttgcatacag

SEQ ID NO: 15506 - DNA, 23 bp, Artificial Sequence
  Synthetic
ccgttttttttttttgcatacag

SEQ ID NO: 15507 - DNA, 23 bp, Artificial Sequence
  Synthetic
ccgttttttttttttgcattcag

SEQ ID NO: 15508 - DNA, 23 bp, Artificial Sequence
  Synthetic
ccgttttttttttttgcattcag

SEQ ID NO: 15509 - DNA, 23 bp, Artificial Sequence
  Synthetic
ccgttttttttttttgcatccag

SEQ ID NO: 15510 - DNA, 23 bp, Artificial Sequence
  Synthetic
ccgttttttttttttgcatgcag

SEQ ID NO: 15511 - DNA, 23 bp, Artificial Sequence
  Synthetic
ccgttttttttttttggatgcag

SEQ ID NO: 15512 - DNA, 23 bp, Artificial Sequence
  Synthetic
ccgttttttttttttggatgcag

SEQ ID NO: 15513 - DNA, 23 bp, Artificial Sequence
  Synthetic
ccgttttttttttttggatgcag

SEQ ID NO: 15514 - DNA, 23 bp, Artificial Sequence
  Synthetic
ccgttttttttttttcacgtgcc

SEQ ID NO: 15515 - DNA, 23 bp, Artificial Sequence
  Synthetic
ccgttttttttttttcacgtgcc

SEQ ID NO: 15516 - DNA, 23 bp, Artificial Sequence
  Synthetic
ccgttttttttttttcacgtgcc

SEQ ID NO: 15517 - DNA, 23 bp, Artificial Sequence
  Synthetic
ccgttttttttttttcacgtgcc

SEQ ID NO: 15518 - DNA, 23 bp, Artificial Sequence
  Synthetic
ccgttttttttttttcacgtgcc

SEQ ID NO: 15519 - DNA, 23 bp, Artificial Sequence
  Synthetic
ccgttttttttttttgcatgtgc

SEQ ID NO: 15520 - DNA, 23 bp, Artificial Sequence
  Synthetic
ccgttttttttttttgggaatga

SEQ ID NO: 15521 - DNA, 23 bp, Artificial Sequence
  Synthetic
ccgttttttttttttgggaatga

SEQ ID NO: 15522 - DNA, 23 bp, Artificial Sequence
  Synthetic
ccgttttttttttttgggaatga

SEQ ID NO: 15523 - DNA, 23 bp, Artificial Sequence
  Synthetic
ccgttttttttttttgggaatga

SEQ ID NO: 15524 - DNA, 23 bp, Artificial Sequence
  Synthetic
ccgttttttttttttgggaatga

SEQ ID NO: 15525 - DNA, 23 bp, Artificial Sequence
  Synthetic
ccgttttttttttttgggaatga

SEQ ID NO: 15526 - DNA, 23 bp, Artificial Sequence
  Synthetic
ccgttttttttttttgggaatga

SEQ ID NO: 15527 - DNA, 23 bp, Artificial Sequence
  Synthetic
ccgttttttttttttgggaatga

SEQ ID NO: 15528 - DNA, 23 bp, Artificial Sequence
  Synthetic
ccgttttttttttttgggaatga

SEQ ID NO: 15529 - DNA, 23 bp, Artificial Sequence
  Synthetic
ccgttttttttttttgggaatga

SEQ ID NO: 15530 - DNA, 23 bp, Artificial Sequence
  Synthetic
ccgttttttttttttgggaatga

SEQ ID NO: 15531 - DNA, 23 bp, Artificial Sequence
  Synthetic
ccgttttttttttttgggaatga

SEQ ID NO: 15532 - DNA, 23 bp, Artificial Sequence
  Synthetic
ccgttttttttttttgggaatga

SEQ ID NO: 15533 - DNA, 23 bp, Artificial Sequence
  Synthetic
ccgttttttttttttaggaatga

SEQ ID NO: 15534 - DNA, 23 bp, Artificial Sequence
  Synthetic
ccgttttttttttttaggaatga

SEQ ID NO: 15535 - DNA, 23 bp, Artificial Sequence
  Synthetic
ccgttttttttttttaggaatgg

SEQ ID NO: 15536 - DNA, 23 bp, Artificial Sequence
  Synthetic
ccgttttttttttttaggaatga

SEQ ID NO: 15537 - DNA, 23 bp, Artificial Sequence
  Synthetic
ccgttttttttttttgatcatgc

SEQ ID NO: 15538 - DNA, 23 bp, Artificial Sequence
  Synthetic
ccgttttttttttttgatcatgc

SEQ ID NO: 15539 - DNA, 23 bp, Artificial Sequence
  Synthetic
ccgttttttttttttgatcatgc

SEQ ID NO: 15540 - DNA, 23 bp, Artificial Sequence
  Synthetic
ccgttttttttttttgatcatgc

SEQ ID NO: 15541 - DNA, 23 bp, Artificial Sequence
  Synthetic
ccgttttttttttttagatcatg

SEQ ID NO: 15542 - DNA, 23 bp, Artificial Sequence
  Synthetic
ccgttttttttttttagatcatg

SEQ ID NO: 15543 - DNA, 23 bp, Artificial Sequence
  Synthetic
ccgttttttttttttagatcatg

SEQ ID NO: 15544 - DNA, 23 bp, Artificial Sequence
  Synthetic
ccgttttttttttttagatcatg

SEQ ID NO: 15545 - DNA, 23 bp, Artificial Sequence
  Synthetic
ccgttttttttttttccgacctg

SEQ ID NO: 15546 - DNA, 23 bp, Artificial Sequence
  Synthetic
ccgttttttttttttccgacctg

SEQ ID NO: 15547 - DNA, 23 bp, Artificial Sequence
  Synthetic
ccgttttttttttttggcaagtc

SEQ ID NO: 15548 - DNA, 23 bp, Artificial Sequence
  Synthetic
ccgttttttttttttcgacaagt

SEQ ID NO: 15549 - DNA, 23 bp, Artificial Sequence
  Synthetic
ccgttttttttttttggcaagtc

SEQ ID NO: 15550 - DNA, 23 bp, Artificial Sequence
  Synthetic
ccgttttttttttttggcaagtc

SEQ ID NO: 15551 - DNA, 23 bp, Artificial Sequence
  Synthetic
ccgttttttttttttggcaagtc

SEQ ID NO: 15552 - DNA, 23 bp, Artificial Sequence
  Synthetic
ccgttttttttttttggcaagtc

SEQ ID NO: 15553 - DNA, 23 bp, Artificial Sequence
  Synthetic
ccgttttttttttttggcaagtc

SEQ ID NO: 15554 - DNA, 23 bp, Artificial Sequence
  Synthetic
ccgttttttttttttggcaagtc

SEQ ID NO: 15555 - DNA, 23 bp, Artificial Sequence
  Synthetic
ccgttttttttttttggcaagtc

SEQ ID NO: 15556 - DNA, 23 bp, Artificial Sequence
  Synthetic
ccgttttttttttttcggcaagt

SEQ ID NO: 15557 - DNA, 23 bp, Artificial Sequence
  Synthetic
ccgttttttttttttcggcaagt

SEQ ID NO: 15558 - DNA, 23 bp, Artificial Sequence
  Synthetic
ccgttttttttttttcggcaagt

SEQ ID NO: 15559 - DNA, 23 bp, Artificial Sequence
  Synthetic
ccgttttttttttttcggcaagt

SEQ ID NO: 15560 - DNA, 23 bp, Artificial Sequence
  Synthetic
ccgttttttttttttcggcaagt

SEQ ID NO: 15561 - DNA, 23 bp, Artificial Sequence
  Synthetic
ccgttttttttttttaggcaagt

SEQ ID NO: 15562 - DNA, 23 bp, Artificial Sequence
  Synthetic
ccgttttttttttttaggcaagt

SEQ ID NO: 15563 - DNA, 23 bp, Artificial Sequence
  Synthetic
ccgttttttttttttaggcaagt

SEQ ID NO: 15564 - DNA, 23 bp, Artificial Sequence
  Synthetic
ccgttttttttttttaggcaagt

SEQ ID NO: 15565 - DNA, 23 bp, Artificial Sequence
  Synthetic
ccgttttttttttttaggcaagt

SEQ ID NO: 15566 - DNA, 23 bp, Artificial Sequence
  Synthetic
ccgttttttttttttggcaagtc

SEQ ID NO: 15567 - DNA, 23 bp, Artificial Sequence
  Synthetic
ccgttttttttttttaggcaagt

SEQ ID NO: 15568 - DNA, 23 bp, Artificial Sequence
  Synthetic
ccgttttttttttttaggcaagt

SEQ ID NO: 15569 - DNA, 23 bp, Artificial Sequence
  Synthetic
ccgttttttttttttaggcaagt

SEQ ID NO: 15570 - DNA, 23 bp, Artificial Sequence
  Synthetic
ccgttttttttttttggcaagtc

SEQ ID NO: 15571 - DNA, 23 bp, Artificial Sequence
  Synthetic
ccgttttttttttttggcaagtc

SEQ ID NO: 15572 - DNA, 23 bp, Artificial Sequence
  Synthetic
ccgttttttttttttcggcaagt

SEQ ID NO: 15573 - DNA, 23 bp, Artificial Sequence
  Synthetic
ccgttttttttttttggcaagtc

SEQ ID NO: 15574 - DNA, 23 bp, Artificial Sequence
  Synthetic
ccgttttttttttttggcaagtc

SEQ ID NO: 15575 - DNA, 23 bp, Artificial Sequence
  Synthetic
ccgttttttttttttggcaagtc

SEQ ID NO: 15576 - DNA, 23 bp, Artificial Sequence
  Synthetic
ccgttttttttttttgagcaagt

SEQ ID NO: 15577 - DNA, 23 bp, Artificial Sequence
  Synthetic
ccgttttttttttttaggcaatt

SEQ ID NO: 15578 - DNA, 23 bp, Artificial Sequence
  Synthetic
ccgttttttttttttcggcaaat

SEQ ID NO: 15579 - DNA, 23 bp, Artificial Sequence
  Synthetic
ccgttttttttttttgtgatatt

SEQ ID NO: 15580 - DNA, 23 bp, Artificial Sequence
  Synthetic
ccgttttttttttttgtgatatt

SEQ ID NO: 15581 - DNA, 23 bp, Artificial Sequence
  Synthetic
ccgttttttttttttatattggc

SEQ ID NO: 15582 - DNA, 23 bp, Artificial Sequence
  Synthetic
ccgttttttttttttatattggc

SEQ ID NO: 15583 - DNA, 23 bp, Artificial Sequence
  Synthetic
ccgttttttttttttatattggc

SEQ ID NO: 15584 - DNA, 23 bp, Artificial Sequence
  Synthetic
ccgttttttttttttatattggc

SEQ ID NO: 15585 - DNA, 23 bp, Artificial Sequence
  Synthetic
ccgttttttttttttatattggc

SEQ ID NO: 15586 - DNA, 23 bp, Artificial Sequence
  Synthetic
ccgttttttttttttatattggc

SEQ ID NO: 15587 - DNA, 23 bp, Artificial Sequence
  Synthetic
ccgttttttttttttatattggc

SEQ ID NO: 15588 - DNA, 23 bp, Artificial Sequence
  Synthetic
ccgttttttttttttgtattggc

SEQ ID NO: 15589 - DNA, 23 bp, Artificial Sequence
  Synthetic
ccgttttttttttttatattggc

SEQ ID NO: 15590 - DNA, 23 bp, Artificial Sequence
  Synthetic
ccgttttttttttttgcagcatc

SEQ ID NO: 15591 - DNA, 23 bp, Artificial Sequence
  Synthetic
ccgttttttttttttgcagcatc

SEQ ID NO: 15592 - DNA, 23 bp, Artificial Sequence
  Synthetic
ccgttttttttttttgcagcatc

SEQ ID NO: 15593 - DNA, 23 bp, Artificial Sequence
  Synthetic
ccgttttttttttttgcagcatc

SEQ ID NO: 15594 - DNA, 23 bp, Artificial Sequence
  Synthetic
ccgttttttttttttgcagcatc

SEQ ID NO: 15595 - DNA, 23 bp, Artificial Sequence
  Synthetic
ccgttttttttttttgcagcatc

SEQ ID NO: 15596 - DNA, 23 bp, Artificial Sequence
  Synthetic
ccgttttttttttttgcagcatc

SEQ ID NO: 15597 - DNA, 23 bp, Artificial Sequence
  Synthetic
ccgttttttttttttgcagcatc

SEQ ID NO: 15598 - DNA, 23 bp, Artificial Sequence
  Synthetic
ccgttttttttttttcagcatca

SEQ ID NO: 15599 - DNA, 23 bp, Artificial Sequence
  Synthetic
ccgttttttttttttggagctcc

SEQ ID NO: 15600 - DNA, 23 bp, Artificial Sequence
  Synthetic
ccgttttttttttttggagctcc

SEQ ID NO: 15601 - DNA, 23 bp, Artificial Sequence
  Synthetic
ccgttttttttttttggagctcc

SEQ ID NO: 15602 - DNA, 23 bp, Artificial Sequence
  Synthetic
ccgttttttttttttggagctcc

SEQ ID NO: 15603 - DNA, 23 bp, Artificial Sequence
  Synthetic
ccgttttttttttttggagctcc

SEQ ID NO: 15604 - DNA, 23 bp, Artificial Sequence
  Synthetic
ccgttttttttttttggagctcc

SEQ ID NO: 15605 - DNA, 23 bp, Artificial Sequence
  Synthetic
ccgttttttttttttggagctcc

SEQ ID NO: 15606 - DNA, 23 bp, Artificial Sequence
  Synthetic
ccgttttttttttttggagctcc

SEQ ID NO: 15607 - DNA, 23 bp, Artificial Sequence
  Synthetic
ccgttttttttttttggagctcc

SEQ ID NO: 15608 - DNA, 23 bp, Artificial Sequence
  Synthetic
ccgttttttttttttgcgctatc

SEQ ID NO: 15609 - DNA, 23 bp, Artificial Sequence
  Synthetic
ccgttttttttttttgcgctatc

SEQ ID NO: 15610 - DNA, 23 bp, Artificial Sequence
  Synthetic
ccgttttttttttttgcgctatc

SEQ ID NO: 15611 - DNA, 23 bp, Artificial Sequence
  Synthetic
ccgttttttttttttgcgctatc

SEQ ID NO: 15612 - DNA, 23 bp, Artificial Sequence
  Synthetic
ccgttttttttttttatcaatgc

SEQ ID NO: 15613 - DNA, 23 bp, Artificial Sequence
  Synthetic
ccgttttttttttttatcaatgc

SEQ ID NO: 15614 - DNA, 23 bp, Artificial Sequence
  Synthetic
ccgttttttttttttatcaatgc

SEQ ID NO: 15615 - DNA, 23 bp, Artificial Sequence
  Synthetic
ccgttttttttttttatcaatgc

SEQ ID NO: 15616 - DNA, 23 bp, Artificial Sequence
  Synthetic
ccgttttttttttttgaggtgga

SEQ ID NO: 15617 - DNA, 23 bp, Artificial Sequence
  Synthetic
ccgttttttttttttgaggtgga

SEQ ID NO: 15618 - DNA, 23 bp, Artificial Sequence
  Synthetic
ccgttttttttttttagttcctc

SEQ ID NO: 15619 - DNA, 23 bp, Artificial Sequence
  Synthetic
ccgttttttttttttagttcccc

SEQ ID NO: 15620 - DNA, 23 bp, Artificial Sequence
  Synthetic
ccgttttttttttttagttcccc

SEQ ID NO: 15621 - DNA, 23 bp, Artificial Sequence
  Synthetic
ccgttttttttttttagttcccc

SEQ ID NO: 15622 - DNA, 23 bp, Artificial Sequence
  Synthetic
ccgttttttttttttagttcccc

SEQ ID NO: 15623 - DNA, 23 bp, Artificial Sequence
  Synthetic
ccgttttttttttttagttcccc

SEQ ID NO: 15624 - DNA, 23 bp, Artificial Sequence
  Synthetic
ccgttttttttttttagttcccc

SEQ ID NO: 15625 - DNA, 23 bp, Artificial Sequence
  Synthetic
ccgttttttttttttagttcccc

SEQ ID NO: 15626 - DNA, 23 bp, Artificial Sequence
  Synthetic
ccgttttttttttttagttcccc

SEQ ID NO: 15627 - DNA, 23 bp, Artificial Sequence
  Synthetic
ccgttttttttttttagttcccc

SEQ ID NO: 15628 - DNA, 23 bp, Artificial Sequence
  Synthetic
ccgttttttttttttagttcaag

SEQ ID NO: 15629 - DNA, 23 bp, Artificial Sequence
  Synthetic
ccgttttttttttttagttcaag

SEQ ID NO: 15630 - DNA, 23 bp, Artificial Sequence
  Synthetic
ccgttttttttttttagttcaag

SEQ ID NO: 15631 - DNA, 23 bp, Artificial Sequence
  Synthetic
ccgttttttttttttagttcaag

SEQ ID NO: 15632 - DNA, 23 bp, Artificial Sequence
  Synthetic
ccgttttttttttttagttcaag

SEQ ID NO: 15633 - DNA, 23 bp, Artificial Sequence
  Synthetic
ccgttttttttttttagttcaag

SEQ ID NO: 15634 - DNA, 23 bp, Artificial Sequence
  Synthetic
ccgttttttttttttagttcaag

SEQ ID NO: 15635 - DNA, 23 bp, Artificial Sequence
  Synthetic
ccgttttttttttttatcaacgc

SEQ ID NO: 15636 - DNA, 23 bp, Artificial Sequence
  Synthetic
ccgttttttttttttatcaacgc

SEQ ID NO: 15637 - DNA, 23 bp, Artificial Sequence
  Synthetic
ccgttttttttttttatcaaagc

SEQ ID NO: 15638 - DNA, 23 bp, Artificial Sequence
  Synthetic
ccgttttttttttttaggggtga

SEQ ID NO: 15639 - DNA, 23 bp, Artificial Sequence
  Synthetic
ccgttttttttttttaggggcga

SEQ ID NO: 15640 - DNA, 23 bp, Artificial Sequence
  Synthetic
ccgttttttttttttaggggcga

SEQ ID NO: 15641 - DNA, 23 bp, Artificial Sequence
  Synthetic
ccgttttttttttttggggcaaa

SEQ ID NO: 15642 - DNA, 23 bp, Artificial Sequence
  Synthetic
ccgttttttttttttcgggcaaa

SEQ ID NO: 15643 - DNA, 23 bp, Artificial Sequence
  Synthetic
ccgttttttttttttcgggcaaa

SEQ ID NO: 15644 - DNA, 23 bp, Artificial Sequence
  Synthetic
ccgttttttttttttggggcaaa

SEQ ID NO: 15645 - DNA, 23 bp, Artificial Sequence
  Synthetic
ccgttttttttttttggggcaaa

SEQ ID NO: 15646 - DNA, 23 bp, Artificial Sequence
  Synthetic
ccgttttttttttttagggcaat

SEQ ID NO: 15647 - DNA, 23 bp, Artificial Sequence
  Synthetic
ccgttttttttttttagggcaat

SEQ ID NO: 15648 - DNA, 23 bp, Artificial Sequence
  Synthetic
ccgttttttttttttagggaaac

SEQ ID NO: 15649 - DNA, 23 bp, Artificial Sequence
  Synthetic
ccgttttttttttttgggcaact

SEQ ID NO: 15650 - DNA, 23 bp, Artificial Sequence
  Synthetic
ccgttttttttttttcggacaaa

SEQ ID NO: 15651 - DNA, 23 bp, Artificial Sequence
  Synthetic
ccgttttttttttttgagcaaat

SEQ ID NO: 15652 - DNA, 23 bp, Artificial Sequence
  Synthetic
ccgttttttttttttagggcaac

SEQ ID NO: 15653 - DNA, 23 bp, Artificial Sequence
  Synthetic
ccgttttttttttttgagtttgt

SEQ ID NO: 15654 - DNA, 23 bp, Artificial Sequence
  Synthetic
ccgttttttttttttgagtttgt

SEQ ID NO: 15655 - DNA, 23 bp, Artificial Sequence
  Synthetic
ccgttttttttttttgagtttgt

SEQ ID NO: 15656 - DNA, 23 bp, Artificial Sequence
  Synthetic
ccgttttttttttttccagggaa

SEQ ID NO: 15657 - DNA, 23 bp, Artificial Sequence
  Synthetic
ccgttttttttttttggatgggt

SEQ ID NO: 15658 - DNA, 23 bp, Artificial Sequence
  Synthetic
ccgttttttttttttggatgggt

SEQ ID NO: 15659 - DNA, 23 bp, Artificial Sequence
  Synthetic
ccgttttttttttttgaagcctt

SEQ ID NO: 15660 - DNA, 23 bp, Artificial Sequence
  Synthetic
ccgttttttttttttgaagccct

SEQ ID NO: 15661 - DNA, 23 bp, Artificial Sequence
  Synthetic
ccgttttttttttttccagccaa

SEQ ID NO: 15662 - DNA, 23 bp, Artificial Sequence
  Synthetic
ccgttttttttttttccagccaa

SEQ ID NO: 15663 - DNA, 23 bp, Artificial Sequence
  Synthetic
ccgttttttttttttccagccaa

SEQ ID NO: 15664 - DNA, 23 bp, Artificial Sequence
  Synthetic
ccgttttttttttttaatcaatg

SEQ ID NO: 15665 - DNA, 23 bp, Artificial Sequence
  Synthetic
ccgttttttttttttaatcaatg

SEQ ID NO: 15666 - DNA, 23 bp, Artificial Sequence
  Synthetic
ccgttttttttttttaatcaatg

SEQ ID NO: 15667 - DNA, 23 bp, Artificial Sequence
  Synthetic
ccgttttttttttttaatcaatg

SEQ ID NO: 15668 - DNA, 23 bp, Artificial Sequence
  Synthetic
ccgttttttttttttgcaaagaa

SEQ ID NO: 15669 - DNA, 23 bp, Artificial Sequence
  Synthetic
ccgttttttttttttcaaagaag

SEQ ID NO: 15670 - DNA, 23 bp, Artificial Sequence
  Synthetic
ccgttttttttttttcaaagaag

SEQ ID NO: 15671 - DNA, 23 bp, Artificial Sequence
  Synthetic
ccgttttttttttttgaagcctc

SEQ ID NO: 15672 - DNA, 23 bp, Artificial Sequence
  Synthetic
ccgttttttttttttgaagcctc

SEQ ID NO: 15673 - DNA, 23 bp, Artificial Sequence
  Synthetic
ccgttttttttttttcctaaaaa

SEQ ID NO: 15674 - DNA, 23 bp, Artificial Sequence
  Synthetic
ccgttttttttttttcctaaaaa

SEQ ID NO: 15675 - DNA, 23 bp, Artificial Sequence
  Synthetic
ccgttttttttttttcctaaaaa

SEQ ID NO: 15676 - DNA, 23 bp, Artificial Sequence
  Synthetic
ccgttttttttttttctaaaaat

SEQ ID NO: 15677 - DNA, 23 bp, Artificial Sequence
  Synthetic
ccgttttttttttttcctaaaaa

SEQ ID NO: 15678 - DNA, 23 bp, Artificial Sequence
  Synthetic
ccgttttttttttttcctaaaaa

SEQ ID NO: 15679 - DNA, 23 bp, Artificial Sequence
  Synthetic
ccgttttttttttttcctaaaaa

SEQ ID NO: 15680 - DNA, 23 bp, Artificial Sequence
  Synthetic
ccgttttttttttttcctaaaaa

SEQ ID NO: 15681 - DNA, 23 bp, Artificial Sequence
  Synthetic
ccgttttttttttttcctaaaaa

SEQ ID NO: 15682 - DNA, 23 bp, Artificial Sequence
  Synthetic
ccgttttttttttttcctaaaaa

SEQ ID NO: 15683 - DNA, 23 bp, Artificial Sequence
  Synthetic
ccgttttttttttttcctaaaaa

SEQ ID NO: 15684 - DNA, 23 bp, Artificial Sequence
  Synthetic
ccgttttttttttttcctaaaaa

SEQ ID NO: 15685 - DNA, 23 bp, Artificial Sequence
  Synthetic
ccgttttttttttttcctaaaaa

SEQ ID NO: 15686 - DNA, 23 bp, Artificial Sequence
  Synthetic
ccgttttttttttttcctaaaaa

SEQ ID NO: 15687 - DNA, 23 bp, Artificial Sequence
  Synthetic
ccgttttttttttttcctaaaaa

SEQ ID NO: 15688 - DNA, 23 bp, Artificial Sequence
  Synthetic
ccgttttttttttttcctaaaaa

SEQ ID NO: 15689 - DNA, 23 bp, Artificial Sequence
  Synthetic
ccgttttttttttttcctaaaaa

SEQ ID NO: 15690 - DNA, 23 bp, Artificial Sequence
  Synthetic
ccgttttttttttttcctaaaaa

SEQ ID NO: 15691 - DNA, 23 bp, Artificial Sequence
  Synthetic
ccgttttttttttttcctaaaaa

SEQ ID NO: 15692 - DNA, 23 bp, Artificial Sequence
  Synthetic
ccgttttttttttttatgagccg

SEQ ID NO: 15693 - DNA, 23 bp, Artificial Sequence
  Synthetic
ccgttttttttttttcaacgtca

SEQ ID NO: 15694 - DNA, 23 bp, Artificial Sequence
  Synthetic
ccgttttttttttttcaacatca

SEQ ID NO: 15695 - DNA, 23 bp, Artificial Sequence
  Synthetic
ccgttttttttttttcttaagct

SEQ ID NO: 15696 - DNA, 23 bp, Artificial Sequence
  Synthetic
ccgttttttttttttcttaagct

SEQ ID NO: 15697 - DNA, 23 bp, Artificial Sequence
  Synthetic
ccgttttttttttttcttaagct

SEQ ID NO: 15698 - DNA, 23 bp, Artificial Sequence
  Synthetic
ccgttttttttttttcttaagct

SEQ ID NO: 15699 - DNA, 23 bp, Artificial Sequence
  Synthetic
ccgttttttttttttcttaagct

SEQ ID NO: 15700 - DNA, 23 bp, Artificial Sequence
  Synthetic
ccgttttttttttttgaatggga

SEQ ID NO: 15701 - DNA, 23 bp, Artificial Sequence
  Synthetic
ccgttttttttttttacaagttc

SEQ ID NO: 15702 - DNA, 23 bp, Artificial Sequence
  Synthetic
ccgttttttttttttcagttatc

SEQ ID NO: 15703 - DNA, 23 bp, Artificial Sequence
  Synthetic
ccgttttttttttttatagccct

SEQ ID NO: 15704 - DNA, 23 bp, Artificial Sequence
  Synthetic
ccgttttttttttttcaggagtc

SEQ ID NO: 15705 - DNA, 23 bp, Artificial Sequence
  Synthetic
ccgttttttttttttctacctgc

SEQ ID NO: 15706 - DNA, 23 bp, Artificial Sequence
  Synthetic
ccgttttttttttttctgcactg

SEQ ID NO: 15707 - DNA, 23 bp, Artificial Sequence
  Synthetic
ccgttttttttttttatagccct

SEQ ID NO: 15708 - DNA, 23 bp, Artificial Sequence
  Synthetic
ccgttttttttttttgcattcac

SEQ ID NO: 15709 - DNA, 23 bp, Artificial Sequence
  Synthetic
ccgttttttttttttacaagtta

SEQ ID NO: 15710 - DNA, 23 bp, Artificial Sequence
  Synthetic
ccgttttttttttttgccaagct

SEQ ID NO: 15711 - DNA, 23 bp, Artificial Sequence
  Synthetic
ccgttttttttttttaaagagac

SEQ ID NO: 15712 - DNA, 23 bp, Artificial Sequence
  Synthetic
ccgttttttttttttagctggtt

SEQ ID NO: 15713 - DNA, 23 bp, Artificial Sequence
  Synthetic
ccgttttttttttttacatagga

SEQ ID NO: 15714 - DNA, 23 bp, Artificial Sequence
  Synthetic
ccgttttttttttttcatcatca

SEQ ID NO: 15715 - DNA, 23 bp, Artificial Sequence
  Synthetic
ccgttttttttttttaccatagg

SEQ ID NO: 15716 - DNA, 23 bp, Artificial Sequence
  Synthetic
ccgttttttttttttagctacag

SEQ ID NO: 15717 - DNA, 23 bp, Artificial Sequence
  Synthetic
ccgttttttttttttagtacatc

SEQ ID NO: 15718 - DNA, 23 bp, Artificial Sequence
  Synthetic
ccgttttttttttttagggattc

SEQ ID NO: 15719 - DNA, 23 bp, Artificial Sequence
  Synthetic
ccgttttttttttttcagaagca

SEQ ID NO: 15720 - DNA, 23 bp, Artificial Sequence
  Synthetic
ccgttttttttttttgaaggcaa

SEQ ID NO: 15721 - DNA, 23 bp, Artificial Sequence
  Synthetic
ccgttttttttttttacaaacca

SEQ ID NO: 15722 - DNA, 23 bp, Artificial Sequence
  Synthetic
ccgttttttttttttaaaccatg

SEQ ID NO: 15723 - DNA, 23 bp, Artificial Sequence
  Synthetic
ccgttttttttttttgccaatat

SEQ ID NO: 15724 - DNA, 23 bp, Artificial Sequence
  Synthetic
ccgttttttttttttcaagtgcc

SEQ ID NO: 15725 - DNA, 23 bp, Artificial Sequence
  Synthetic
ccgttttttttttttctacctgc

SEQ ID NO: 15726 - DNA, 23 bp, Artificial Sequence
  Synthetic
ccgttttttttttttctgcacta

SEQ ID NO: 15727 - DNA, 23 bp, Artificial Sequence
  Synthetic
ccgttttttttttttctcaccga

SEQ ID NO: 15728 - DNA, 23 bp, Artificial Sequence
  Synthetic
ccgttttttttttttgtacaatc

SEQ ID NO: 15729 - DNA, 23 bp, Artificial Sequence
  Synthetic
ccgttttttttttttacccaccg

SEQ ID NO: 15730 - DNA, 23 bp, Artificial Sequence
  Synthetic
ccgttttttttttttctcaccga

SEQ ID NO: 15731 - DNA, 23 bp, Artificial Sequence
  Synthetic
ccgttttttttttttagtgaatt

SEQ ID NO: 15732 - DNA, 23 bp, Artificial Sequence
  Synthetic
ccgttttttttttttcccttatc

SEQ ID NO: 15733 - DNA, 23 bp, Artificial Sequence
  Synthetic
ccgttttttttttttagcccaaa

SEQ ID NO: 15734 - DNA, 23 bp, Artificial Sequence
  Synthetic
ccgttttttttttttccctccac

SEQ ID NO: 15735 - DNA, 23 bp, Artificial Sequence
  Synthetic
ccgttttttttttttcctaatat

SEQ ID NO: 15736 - DNA, 23 bp, Artificial Sequence
  Synthetic
ccgttttttttttttcacatgga

SEQ ID NO: 15737 - DNA, 23 bp, Artificial Sequence
  Synthetic
ccgttttttttttttccaacaac

SEQ ID NO: 15738 - DNA, 23 bp, Artificial Sequence
  Synthetic
ccgttttttttttttctgggtgg

SEQ ID NO: 15739 - DNA, 23 bp, Artificial Sequence
  Synthetic
ccgttttttttttttctatctcc

SEQ ID NO: 15740 - DNA, 23 bp, Artificial Sequence
  Synthetic
ccgttttttttttttaacaggta

SEQ ID NO: 15741 - DNA, 23 bp, Artificial Sequence
  Synthetic
ccgttttttttttttagttttgc

SEQ ID NO: 15742 - DNA, 23 bp, Artificial Sequence
  Synthetic
ccgttttttttttttagttttgc

SEQ ID NO: 15743 - DNA, 23 bp, Artificial Sequence
  Synthetic
ccgttttttttttttcctgcact

SEQ ID NO: 15744 - DNA, 23 bp, Artificial Sequence
  Synthetic
ccgttttttttttttggcatagg

SEQ ID NO: 15745 - DNA, 23 bp, Artificial Sequence
  Synthetic
ccgttttttttttttagactccg

SEQ ID NO: 15746 - DNA, 23 bp, Artificial Sequence
  Synthetic
ccgttttttttttttaacatcag

SEQ ID NO: 15747 - DNA, 23 bp, Artificial Sequence
  Synthetic
ccgttttttttttttgcctgtct

SEQ ID NO: 15748 - DNA, 23 bp, Artificial Sequence
  Synthetic
ccgttttttttttttctgtcaat

SEQ ID NO: 15749 - DNA, 23 bp, Artificial Sequence
  Synthetic
ccgttttttttttttacagttgc

SEQ ID NO: 15750 - DNA, 23 bp, Artificial Sequence
  Synthetic
ccgttttttttttttcatggtta

SEQ ID NO: 15751 - DNA, 23 bp, Artificial Sequence
  Synthetic
ccgttttttttttttcagttctt

SEQ ID NO: 15752 - DNA, 23 bp, Artificial Sequence
  Synthetic
ccgttttttttttttaagtgtca

SEQ ID NO: 15753 - DNA, 23 bp, Artificial Sequence
  Synthetic
ccgttttttttttttgggtattt

SEQ ID NO: 15754 - DNA, 23 bp, Artificial Sequence
  Synthetic
ccgttttttttttttaacggaac

SEQ ID NO: 15755 - DNA, 23 bp, Artificial Sequence
  Synthetic
ccgttttttttttttgaaatccc

SEQ ID NO: 15756 - DNA, 23 bp, Artificial Sequence
  Synthetic
ccgttttttttttttggtaatcc

SEQ ID NO: 15757 - DNA, 23 bp, Artificial Sequence
  Synthetic
ccgttttttttttttgttcctgc

SEQ ID NO: 15758 - DNA, 23 bp, Artificial Sequence
  Synthetic
ccgttttttttttttagaccgag

SEQ ID NO: 15759 - DNA, 23 bp, Artificial Sequence
  Synthetic
ccgttttttttttttgcctatcc

SEQ ID NO: 15760 - DNA, 23 bp, Artificial Sequence
  Synthetic
ccgttttttttttttgcggaact

SEQ ID NO: 15761 - DNA, 23 bp, Artificial Sequence
  Synthetic
ccgttttttttttttcaatagac

SEQ ID NO: 15762 - DNA, 23 bp, Artificial Sequence
  Synthetic
ccgttttttttttttaccgattt

SEQ ID NO: 15763 - DNA, 23 bp, Artificial Sequence
  Synthetic
ccgttttttttttttctgatttc

SEQ ID NO: 15764 - DNA, 23 bp, Artificial Sequence
  Synthetic
ccgttttttttttttctgcaaac

SEQ ID NO: 15765 - DNA, 23 bp, Artificial Sequence
  Synthetic
ccgttttttttttttccagtcga

SEQ ID NO: 15766 - DNA, 23 bp, Artificial Sequence
  Synthetic
ccgttttttttttttctgagtgt

SEQ ID NO: 15767 - DNA, 23 bp, Artificial Sequence
  Synthetic
ccgttttttttttttctgagagt

SEQ ID NO: 15768 - DNA, 23 bp, Artificial Sequence
  Synthetic
ccgttttttttttttccagtcgg

SEQ ID NO: 15769 - DNA, 23 bp, Artificial Sequence
  Synthetic
ccgttttttttttttagctatgc

SEQ ID NO: 15770 - DNA, 23 bp, Artificial Sequence
  Synthetic
ccgttttttttttttcaacttag

SEQ ID NO: 15771 - DNA, 23 bp, Artificial Sequence
  Synthetic
ccgttttttttttttaatgcaac

SEQ ID NO: 15772 - DNA, 23 bp, Artificial Sequence
  Synthetic
ccgttttttttttttcaaccagc

SEQ ID NO: 15773 - DNA, 23 bp, Artificial Sequence
  Synthetic
ccgttttttttttttacaaaatc

SEQ ID NO: 15774 - DNA, 23 bp, Artificial Sequence
  Synthetic
ccgttttttttttttatacagct

SEQ ID NO: 15775 - DNA, 23 bp, Artificial Sequence
  Synthetic
ccgttttttttttttcaggccgg

SEQ ID NO: 15776 - DNA, 23 bp, Artificial Sequence
  Synthetic
ccgttttttttttttacctgcac

SEQ ID NO: 15777 - DNA, 23 bp, Artificial Sequence
  Synthetic
ccgttttttttttttctcaataa

SEQ ID NO: 15778 - DNA, 23 bp, Artificial Sequence
  Synthetic
ccgttttttttttttcaaaaatg

SEQ ID NO: 15779 - DNA, 23 bp, Artificial Sequence
  Synthetic
ccgttttttttttttacaataca

SEQ ID NO: 15780 - DNA, 23 bp, Artificial Sequence
  Synthetic
ccgttttttttttttacaagatc

SEQ ID NO: 15781 - DNA, 23 bp, Artificial Sequence
  Synthetic
ccgttttttttttttaccccggg

SEQ ID NO: 15782 - DNA, 23 bp, Artificial Sequence
  Synthetic
ccgttttttttttttatcaggtc

SEQ ID NO: 15783 - DNA, 23 bp, Artificial Sequence
  Synthetic
ccgttttttttttttcccgtatc

SEQ ID NO: 15784 - DNA, 23 bp, Artificial Sequence
  Synthetic
ccgttttttttttttagccagtc

SEQ ID NO: 15785 - DNA, 23 bp, Artificial Sequence
  Synthetic
ccgttttttttttttccactgtg

SEQ ID NO: 15786 - DNA, 23 bp, Artificial Sequence
  Synthetic
ccgttttttttttttcctggaca

SEQ ID NO: 15787 - DNA, 23 bp, Artificial Sequence
  Synthetic
ccgttttttttttttcgttcagc

SEQ ID NO: 15788 - DNA, 23 bp, Artificial Sequence
  Synthetic
ccgttttttttttttcaagcgca

SEQ ID NO: 15789 - DNA, 23 bp, Artificial Sequence
  Synthetic
ccgttttttttttttaaccacac

SEQ ID NO: 15790 - DNA, 23 bp, Artificial Sequence
  Synthetic
ccgttttttttttttgaacaggc

SEQ ID NO: 15791 - DNA, 23 bp, Artificial Sequence
  Synthetic
ccgttttttttttttgaatgaag

SEQ ID NO: 15792 - DNA, 23 bp, Artificial Sequence
  Synthetic
ccgttttttttttttgaaattcc

SEQ ID NO: 15793 - DNA, 23 bp, Artificial Sequence
  Synthetic
ccgttttttttttttgcagtaga

SEQ ID NO: 15794 - DNA, 23 bp, Artificial Sequence
  Synthetic
ccgttttttttttttgacctagt

SEQ ID NO: 15795 - DNA, 23 bp, Artificial Sequence
  Synthetic
ccgttttttttttttacaccgca

SEQ ID NO: 15796 - DNA, 23 bp, Artificial Sequence
  Synthetic
ccgttttttttttttcacctagt

SEQ ID NO: 15797 - DNA, 23 bp, Artificial Sequence
  Synthetic
ccgttttttttttttgcacatca

SEQ ID NO: 15798 - DNA, 23 bp, Artificial Sequence
  Synthetic
ccgttttttttttttacatagtg

SEQ ID NO: 15799 - DNA, 23 bp, Artificial Sequence
  Synthetic
ccgttttttttttttacagcacg

SEQ ID NO: 15800 - DNA, 23 bp, Artificial Sequence
  Synthetic
ccgttttttttttttagtaagcc

SEQ ID NO: 15801 - DNA, 23 bp, Artificial Sequence
  Synthetic
ccgttttttttttttaatgggca

SEQ ID NO: 15802 - DNA, 23 bp, Artificial Sequence
  Synthetic
ccgttttttttttttctaagggg

SEQ ID NO: 15803 - DNA, 23 bp, Artificial Sequence
  Synthetic
ccgttttttttttttactataca

SEQ ID NO: 15804 - DNA, 23 bp, Artificial Sequence
  Synthetic
ccgttttttttttttaccacaca

SEQ ID NO: 15805 - DNA, 23 bp, Artificial Sequence
  Synthetic
ccgttttttttttttaccataca

SEQ ID NO: 15806 - DNA, 23 bp, Artificial Sequence
  Synthetic
ccgttttttttttttctatgcaa

SEQ ID NO: 15807 - DNA, 23 bp, Artificial Sequence
  Synthetic
ccgttttttttttttgaaaggca

SEQ ID NO: 15808 - DNA, 23 bp, Artificial Sequence
  Synthetic
ccgttttttttttttctatacaa

SEQ ID NO: 15809 - DNA, 23 bp, Artificial Sequence
  Synthetic
ccgttttttttttttactataca

SEQ ID NO: 15810 - DNA, 23 bp, Artificial Sequence
  Synthetic
ccgttttttttttttcagcacaa

SEQ ID NO: 15811 - DNA, 23 bp, Artificial Sequence
  Synthetic
ccgttttttttttttcacacttc

SEQ ID NO: 15812 - DNA, 23 bp, Artificial Sequence
  Synthetic
ccgttttttttttttggtacata

SEQ ID NO: 15813 - DNA, 23 bp, Artificial Sequence
  Synthetic
ccgttttttttttttacaagttc

SEQ ID NO: 15814 - DNA, 23 bp, Artificial Sequence
  Synthetic
ccgttttttttttttcagttatc

SEQ ID NO: 15815 - DNA, 23 bp, Artificial Sequence
  Synthetic
ccgttttttttttttcagctatc

SEQ ID NO: 15816 - DNA, 23 bp, Artificial Sequence
  Synthetic
ccgttttttttttttatagccct

SEQ ID NO: 15817 - DNA, 23 bp, Artificial Sequence
  Synthetic
ccgttttttttttttctgcactg

SEQ ID NO: 15818 - DNA, 23 bp, Artificial Sequence
  Synthetic
ccgttttttttttttatagccct

SEQ ID NO: 15819 - DNA, 23 bp, Artificial Sequence
  Synthetic
ccgttttttttttttacaaattc

SEQ ID NO: 15820 - DNA, 23 bp, Artificial Sequence
  Synthetic
ccgttttttttttttcacaaatt

SEQ ID NO: 15821 - DNA, 23 bp, Artificial Sequence
  Synthetic
ccgttttttttttttcaaacacc

SEQ ID NO: 15822 - DNA, 23 bp, Artificial Sequence
  Synthetic
ccgttttttttttttgcattcac

SEQ ID NO: 15823 - DNA, 23 bp, Artificial Sequence
  Synthetic
ccgttttttttttttacaggtta

SEQ ID NO: 15824 - DNA, 23 bp, Artificial Sequence
  Synthetic
ccgttttttttttttacaagtta

SEQ ID NO: 15825 - DNA, 23 bp, Artificial Sequence
  Synthetic
ccgttttttttttttcattatta

SEQ ID NO: 15826 - DNA, 23 bp, Artificial Sequence
  Synthetic
ccgttttttttttttgcgtacca

SEQ ID NO: 15827 - DNA, 23 bp, Artificial Sequence
  Synthetic
ccgttttttttttttgccaagct

SEQ ID NO: 15828 - DNA, 23 bp, Artificial Sequence
  Synthetic
ccgttttttttttttaaagagac

SEQ ID NO: 15829 - DNA, 23 bp, Artificial Sequence
  Synthetic
ccgttttttttttttaaagagac

SEQ ID NO: 15830 - DNA, 23 bp, Artificial Sequence
  Synthetic
ccgttttttttttttgcaagccc

SEQ ID NO: 15831 - DNA, 23 bp, Artificial Sequence
  Synthetic
ccgttttttttttttgctttttg

SEQ ID NO: 15832 - DNA, 23 bp, Artificial Sequence
  Synthetic
ccgttttttttttttgccctttt

SEQ ID NO: 15833 - DNA, 23 bp, Artificial Sequence
  Synthetic
ccgttttttttttttgccctttc

SEQ ID NO: 15834 - DNA, 23 bp, Artificial Sequence
  Synthetic
ccgttttttttttttgaccatgg

SEQ ID NO: 15835 - DNA, 23 bp, Artificial Sequence
  Synthetic
ccgttttttttttttcagctggt

SEQ ID NO: 15836 - DNA, 23 bp, Artificial Sequence
  Synthetic
ccgttttttttttttgctggttg

SEQ ID NO: 15837 - DNA, 23 bp, Artificial Sequence
  Synthetic
ccgttttttttttttcctctggt

SEQ ID NO: 15838 - DNA, 23 bp, Artificial Sequence
  Synthetic
ccgttttttttttttacatagga

SEQ ID NO: 15839 - DNA, 23 bp, Artificial Sequence
  Synthetic
ccgttttttttttttacatagga

SEQ ID NO: 15840 - DNA, 23 bp, Artificial Sequence
  Synthetic
ccgttttttttttttcatcatca

SEQ ID NO: 15841 - DNA, 23 bp, Artificial Sequence
  Synthetic
ccgttttttttttttacgcgtat

SEQ ID NO: 15842 - DNA, 23 bp, Artificial Sequence
  Synthetic
ccgttttttttttttattcacaa

SEQ ID NO: 15843 - DNA, 23 bp, Artificial Sequence
  Synthetic
ccgttttttttttttgacacgtg

SEQ ID NO: 15844 - DNA, 23 bp, Artificial Sequence
  Synthetic
ccgttttttttttttaccatagg

SEQ ID NO: 15845 - DNA, 23 bp, Artificial Sequence
  Synthetic
ccgttttttttttttccgtggtt

SEQ ID NO: 15846 - DNA, 23 bp, Artificial Sequence
  Synthetic
ccgttttttttttttcatcttta

SEQ ID NO: 15847 - DNA, 23 bp, Artificial Sequence
  Synthetic
ccgttttttttttttcataaagt

SEQ ID NO: 15848 - DNA, 23 bp, Artificial Sequence
  Synthetic
ccgttttttttttttagtgcttt

SEQ ID NO: 15849 - DNA, 23 bp, Artificial Sequence
  Synthetic
ccgttttttttttttagctacag

SEQ ID NO: 15850 - DNA, 23 bp, Artificial Sequence
  Synthetic
ccgttttttttttttagtacatc

SEQ ID NO: 15851 - DNA, 23 bp, Artificial Sequence
  Synthetic
ccgttttttttttttagggattc

SEQ ID NO: 15852 - DNA, 23 bp, Artificial Sequence
  Synthetic
ccgttttttttttttacccatgg

SEQ ID NO: 15853 - DNA, 23 bp, Artificial Sequence
  Synthetic
ccgttttttttttttcaaagttc

SEQ ID NO: 15854 - DNA, 23 bp, Artificial Sequence
  Synthetic
ccgttttttttttttactggtac

SEQ ID NO: 15855 - DNA, 23 bp, Artificial Sequence
  Synthetic
ccgttttttttttttctcaagga

SEQ ID NO: 15856 - DNA, 23 bp, Artificial Sequence
  Synthetic
ccgttttttttttttctagactg

SEQ ID NO: 15857 - DNA, 23 bp, Artificial Sequence
  Synthetic
ccgttttttttttttccaagttc

SEQ ID NO: 15858 - DNA, 23 bp, Artificial Sequence
  Synthetic
ccgttttttttttttacttttgt

SEQ ID NO: 15859 - DNA, 23 bp, Artificial Sequence
  Synthetic
ccgttttttttttttgaaggcaa

SEQ ID NO: 15860 - DNA, 23 bp, Artificial Sequence
  Synthetic
ccgttttttttttttaaaccatg

SEQ ID NO: 15861 - DNA, 23 bp, Artificial Sequence
  Synthetic
ccgttttttttttttgccaatat

SEQ ID NO: 15862 - DNA, 23 bp, Artificial Sequence
  Synthetic
ccgttttttttttttctacctgc

SEQ ID NO: 15863 - DNA, 23 bp, Artificial Sequence
  Synthetic
ccgttttttttttttctgcacta

SEQ ID NO: 15864 - DNA, 23 bp, Artificial Sequence
  Synthetic
ccgttttttttttttctcaccga

SEQ ID NO: 15865 - DNA, 23 bp, Artificial Sequence
  Synthetic
ccgttttttttttttgtacaatc

SEQ ID NO: 15866 - DNA, 23 bp, Artificial Sequence
  Synthetic
ccgttttttttttttccaccgac

SEQ ID NO: 15867 - DNA, 23 bp, Artificial Sequence
  Synthetic
ccgttttttttttttctcaccga

SEQ ID NO: 15868 - DNA, 23 bp, Artificial Sequence
  Synthetic
ccgttttttttttttagtgaatt

SEQ ID NO: 15869 - DNA, 23 bp, Artificial Sequence
  Synthetic
ccgttttttttttttcccttatc

SEQ ID NO: 15870 - DNA, 23 bp, Artificial Sequence
  Synthetic
ccgttttttttttttaactgcct

SEQ ID NO: 15871 - DNA, 23 bp, Artificial Sequence
  Synthetic
ccgttttttttttttagcccaaa

SEQ ID NO: 15872 - DNA, 23 bp, Artificial Sequence
  Synthetic
ccgttttttttttttggctgcaa

SEQ ID NO: 15873 - DNA, 23 bp, Artificial Sequence
  Synthetic
ccgttttttttttttctgatatc

SEQ ID NO: 15874 - DNA, 23 bp, Artificial Sequence
  Synthetic
ccgttttttttttttcctaatat

SEQ ID NO: 15875 - DNA, 23 bp, Artificial Sequence
  Synthetic
ccgttttttttttttgctgcttt

SEQ ID NO: 15876 - DNA, 23 bp, Artificial Sequence
  Synthetic
ccgttttttttttttgctgtcaa

SEQ ID NO: 15877 - DNA, 23 bp, Artificial Sequence
  Synthetic
ccgttttttttttttgggacttt

SEQ ID NO: 15878 - DNA, 23 bp, Artificial Sequence
  Synthetic
ccgttttttttttttcacatgga

SEQ ID NO: 15879 - DNA, 23 bp, Artificial Sequence
  Synthetic
ccgttttttttttttccaatatt

SEQ ID NO: 15880 - DNA, 23 bp, Artificial Sequence
  Synthetic
ccgttttttttttttcaacaaca

SEQ ID NO: 15881 - DNA, 23 bp, Artificial Sequence
  Synthetic
ccgttttttttttttcaacaaca

SEQ ID NO: 15882 - DNA, 23 bp, Artificial Sequence
  Synthetic
ccgttttttttttttaacaggta

SEQ ID NO: 15883 - DNA, 23 bp, Artificial Sequence
  Synthetic
ccgttttttttttttagttttgc

SEQ ID NO: 15884 - DNA, 23 bp, Artificial Sequence
  Synthetic
ccgttttttttttttagttttgc

SEQ ID NO: 15885 - DNA, 23 bp, Artificial Sequence
  Synthetic
ccgttttttttttttcatcgtta

SEQ ID NO: 15886 - DNA, 23 bp, Artificial Sequence
  Synthetic
ccgttttttttttttcatcatta

SEQ ID NO: 15887 - DNA, 23 bp, Artificial Sequence
  Synthetic
ccgttttttttttttcatcatta

SEQ ID NO: 15888 - DNA, 23 bp, Artificial Sequence
  Synthetic
ccgttttttttttttagtggtcc

SEQ ID NO: 15889 - DNA, 23 bp, Artificial Sequence
  Synthetic
ccgttttttttttttggcatagg

SEQ ID NO: 15890 - DNA, 23 bp, Artificial Sequence
  Synthetic
ccgttttttttttttagactccg

SEQ ID NO: 15891 - DNA, 23 bp, Artificial Sequence
  Synthetic
ccgttttttttttttcacacact

SEQ ID NO: 15892 - DNA, 23 bp, Artificial Sequence
  Synthetic
ccgttttttttttttagggagga

SEQ ID NO: 15893 - DNA, 23 bp, Artificial Sequence
  Synthetic
ccgttttttttttttcaagcttt

SEQ ID NO: 15894 - DNA, 23 bp, Artificial Sequence
  Synthetic
ccgttttttttttttacctgcac

SEQ ID NO: 15895 - DNA, 23 bp, Artificial Sequence
  Synthetic
ccgttttttttttttaagtgctc

SEQ ID NO: 15896 - DNA, 23 bp, Artificial Sequence
  Synthetic
ccgttttttttttttcctgcact

SEQ ID NO: 15897 - DNA, 23 bp, Artificial Sequence
  Synthetic
ccgttttttttttttagaagtgc

SEQ ID NO: 15898 - DNA, 23 bp, Artificial Sequence
  Synthetic
ccgttttttttttttaacatcag

SEQ ID NO: 15899 - DNA, 23 bp, Artificial Sequence
  Synthetic
ccgttttttttttttagccgctg

SEQ ID NO: 15900 - DNA, 23 bp, Artificial Sequence
  Synthetic
ccgttttttttttttggcaaagg

SEQ ID NO: 15901 - DNA, 23 bp, Artificial Sequence
  Synthetic
ccgttttttttttttgccgtgac

SEQ ID NO: 15902 - DNA, 23 bp, Artificial Sequence
  Synthetic
ccgttttttttttttgcctgtct

SEQ ID NO: 15903 - DNA, 23 bp, Artificial Sequence
  Synthetic
ccgttttttttttttctgtcaaa

SEQ ID NO: 15904 - DNA, 23 bp, Artificial Sequence
  Synthetic
ccgttttttttttttacagttgc

SEQ ID NO: 15905 - DNA, 23 bp, Artificial Sequence
  Synthetic
ccgttttttttttttccagtcag

SEQ ID NO: 15906 - DNA, 23 bp, Artificial Sequence
  Synthetic
ccgttttttttttttcatggtta

SEQ ID NO: 15907 - DNA, 23 bp, Artificial Sequence
  Synthetic
ccgttttttttttttgaattgcg

SEQ ID NO: 15908 - DNA, 23 bp, Artificial Sequence
  Synthetic
ccgttttttttttttcagttctt

SEQ ID NO: 15909 - DNA, 23 bp, Artificial Sequence
  Synthetic
ccgttttttttttttaagcttgc

SEQ ID NO: 15910 - DNA, 23 bp, Artificial Sequence
  Synthetic
ccgttttttttttttaaacccag

SEQ ID NO: 15911 - DNA, 23 bp, Artificial Sequence
  Synthetic
ccgttttttttttttagacccag

SEQ ID NO: 15912 - DNA, 23 bp, Artificial Sequence
  Synthetic
ccgttttttttttttgggtattt

SEQ ID NO: 15913 - DNA, 23 bp, Artificial Sequence
  Synthetic
ccgttttttttttttaacggaac

SEQ ID NO: 15914 - DNA, 23 bp, Artificial Sequence
  Synthetic
ccgttttttttttttgaaatccc

SEQ ID NO: 15915 - DNA, 23 bp, Artificial Sequence
  Synthetic
ccgttttttttttttgtaatccc

SEQ ID NO: 15916 - DNA, 23 bp, Artificial Sequence
  Synthetic
ccgttttttttttttgttcctgc

SEQ ID NO: 15917 - DNA, 23 bp, Artificial Sequence
  Synthetic
ccgttttttttttttagaccgag

SEQ ID NO: 15918 - DNA, 23 bp, Artificial Sequence
  Synthetic
ccgttttttttttttcctatcct

SEQ ID NO: 15919 - DNA, 23 bp, Artificial Sequence
  Synthetic
ccgttttttttttttacctatcc

SEQ ID NO: 15920 - DNA, 23 bp, Artificial Sequence
  Synthetic
ccgttttttttttttcggaactt

SEQ ID NO: 15921 - DNA, 23 bp, Artificial Sequence
  Synthetic
ccgttttttttttttcagaactt

SEQ ID NO: 15922 - DNA, 23 bp, Artificial Sequence
  Synthetic
ccgttttttttttttcaatagac

SEQ ID NO: 15923 - DNA, 23 bp, Artificial Sequence
  Synthetic
ccgttttttttttttaaaagtgc

SEQ ID NO: 15924 - DNA, 23 bp, Artificial Sequence
  Synthetic
ccgttttttttttttgcacacaa

SEQ ID NO: 15925 - DNA, 23 bp, Artificial Sequence
  Synthetic
ccgttttttttttttgagagggc

SEQ ID NO: 15926 - DNA, 23 bp, Artificial Sequence
  Synthetic
ccgttttttttttttcactcaaa

SEQ ID NO: 15927 - DNA, 23 bp, Artificial Sequence
  Synthetic
ccgttttttttttttaaaagagc

SEQ ID NO: 15928 - DNA, 23 bp, Artificial Sequence
  Synthetic
ccgttttttttttttcaggattg

SEQ ID NO: 15929 - DNA, 23 bp, Artificial Sequence
  Synthetic
ccgttttttttttttatgcatac

SEQ ID NO: 15930 - DNA, 23 bp, Artificial Sequence
  Synthetic
ccgttttttttttttgaagaaca

SEQ ID NO: 15931 - DNA, 23 bp, Artificial Sequence
  Synthetic
ccgttttttttttttgtatgtgg

SEQ ID NO: 15932 - DNA, 23 bp, Artificial Sequence
  Synthetic
ccgttttttttttttaccgattt

SEQ ID NO: 15933 - DNA, 23 bp, Artificial Sequence
  Synthetic
ccgttttttttttttacactgat

SEQ ID NO: 15934 - DNA, 23 bp, Artificial Sequence
  Synthetic
ccgttttttttttttccgatttc

SEQ ID NO: 15935 - DNA, 23 bp, Artificial Sequence
  Synthetic
ccgttttttttttttaacaccag

SEQ ID NO: 15936 - DNA, 23 bp, Artificial Sequence
  Synthetic
ccgttttttttttttaagagagc

SEQ ID NO: 15937 - DNA, 23 bp, Artificial Sequence
  Synthetic
ccgttttttttttttgctttgac

SEQ ID NO: 15938 - DNA, 23 bp, Artificial Sequence
  Synthetic
ccgttttttttttttctgcaaac

SEQ ID NO: 15939 - DNA, 23 bp, Artificial Sequence
  Synthetic
ccgttttttttttttccagtcga

SEQ ID NO: 15940 - DNA, 23 bp, Artificial Sequence
  Synthetic
ccgttttttttttttgctgagtg

SEQ ID NO: 15941 - DNA, 23 bp, Artificial Sequence
  Synthetic
ccgttttttttttttctgagagt

SEQ ID NO: 15942 - DNA, 23 bp, Artificial Sequence
  Synthetic
ccgttttttttttttccagtcgg

SEQ ID NO: 15943 - DNA, 23 bp, Artificial Sequence
  Synthetic
ccgttttttttttttcagtcaag

SEQ ID NO: 15944 - DNA, 23 bp, Artificial Sequence
  Synthetic
ccgttttttttttttagctatgc

SEQ ID NO: 15945 - DNA, 23 bp, Artificial Sequence
  Synthetic
ccgttttttttttttcaacttag

SEQ ID NO: 15946 - DNA, 23 bp, Artificial Sequence
  Synthetic
ccgttttttttttttgccctctc

SEQ ID NO: 15947 - DNA, 23 bp, Artificial Sequence
  Synthetic
ccgttttttttttttgcagcgct

SEQ ID NO: 15948 - DNA, 23 bp, Artificial Sequence
  Synthetic
ccgttttttttttttgaggtcga

SEQ ID NO: 15949 - DNA, 23 bp, Artificial Sequence
  Synthetic
ccgttttttttttttcagcagca

SEQ ID NO: 15950 - DNA, 23 bp, Artificial Sequence
  Synthetic
ccgttttttttttttcaccaatg

SEQ ID NO: 15951 - DNA, 23 bp, Artificial Sequence
  Synthetic
ccgttttttttttttcacttact

SEQ ID NO: 15952 - DNA, 23 bp, Artificial Sequence
  Synthetic
ccgttttttttttttctggagga

SEQ ID NO: 15953 - DNA, 23 bp, Artificial Sequence
  Synthetic
ccgttttttttttttccctcatg

SEQ ID NO: 15954 - DNA, 23 bp, Artificial Sequence
  Synthetic
ccgttttttttttttcggaaggg

SEQ ID NO: 15955 - DNA, 23 bp, Artificial Sequence
  Synthetic
ccgttttttttttttaaaaggtt

SEQ ID NO: 15956 - DNA, 23 bp, Artificial Sequence
  Synthetic
ccgttttttttttttaatgcaac

SEQ ID NO: 15957 - DNA, 23 bp, Artificial Sequence
  Synthetic
ccgttttttttttttctgcaggc

SEQ ID NO: 15958 - DNA, 23 bp, Artificial Sequence
  Synthetic
ccgttttttttttttaggatagg

SEQ ID NO: 15959 - DNA, 23 bp, Artificial Sequence
  Synthetic
ccgttttttttttttaaagtaac

SEQ ID NO: 15960 - DNA, 23 bp, Artificial Sequence
  Synthetic
ccgttttttttttttcatttttc

SEQ ID NO: 15961 - DNA, 23 bp, Artificial Sequence
  Synthetic
ccgttttttttttttgactagat

SEQ ID NO: 15962 - DNA, 23 bp, Artificial Sequence
  Synthetic
ccgttttttttttttaaggcatc

SEQ ID NO: 15963 - DNA, 23 bp, Artificial Sequence
  Synthetic
ccgttttttttttttaacaaaat

SEQ ID NO: 15964 - DNA, 23 bp, Artificial Sequence
  Synthetic
ccgttttttttttttagctcctg

SEQ ID NO: 15965 - DNA, 23 bp, Artificial Sequence
  Synthetic
ccgttttttttttttgctataaa

SEQ ID NO: 15966 - DNA, 23 bp, Artificial Sequence
  Synthetic
ccgttttttttttttctgaccga

SEQ ID NO: 15967 - DNA, 23 bp, Artificial Sequence
  Synthetic
ccgttttttttttttacgggtgc

SEQ ID NO: 15968 - DNA, 23 bp, Artificial Sequence
  Synthetic
ccgttttttttttttgggcacac

SEQ ID NO: 15969 - DNA, 23 bp, Artificial Sequence
  Synthetic
ccgttttttttttttcggtcagg

SEQ ID NO: 15970 - DNA, 23 bp, Artificial Sequence
  Synthetic
ccgttttttttttttcactggac

SEQ ID NO: 15971 - DNA, 23 bp, Artificial Sequence
  Synthetic
ccgttttttttttttgaggcagg

SEQ ID NO: 15972 - DNA, 23 bp, Artificial Sequence
  Synthetic
ccgttttttttttttggcgaccc

SEQ ID NO: 15973 - DNA, 23 bp, Artificial Sequence
  Synthetic
ccgttttttttttttgaggttaa

SEQ ID NO: 15974 - DNA, 23 bp, Artificial Sequence
  Synthetic
ccgttttttttttttacaaccag

SEQ ID NO: 15975 - DNA, 23 bp, Artificial Sequence
  Synthetic
ccgttttttttttttaatcagct

SEQ ID NO: 15976 - DNA, 23 bp, Artificial Sequence
  Synthetic
ccgttttttttttttcaatcagc

SEQ ID NO: 15977 - DNA, 23 bp, Artificial Sequence
  Synthetic
ccgttttttttttttgaaagtgt

SEQ ID NO: 15978 - DNA, 23 bp, Artificial Sequence
  Synthetic
ccgttttttttttttaggctcaa

SEQ ID NO: 15979 - DNA, 23 bp, Artificial Sequence
  Synthetic
ccgttttttttttttctatgcaa

SEQ ID NO: 15980 - DNA, 23 bp, Artificial Sequence
  Synthetic
ccgttttttttttttacccctgg

SEQ ID NO: 15981 - DNA, 23 bp, Artificial Sequence
  Synthetic
ccgttttttttttttcagatgga

SEQ ID NO: 15982 - DNA, 23 bp, Artificial Sequence
  Synthetic
ccgttttttttttttaattgcat

SEQ ID NO: 15983 - DNA, 23 bp, Artificial Sequence
  Synthetic
ccgttttttttttttaaggattt

SEQ ID NO: 15984 - DNA, 23 bp, Artificial Sequence
  Synthetic
ccgttttttttttttagatcaac

SEQ ID NO: 15985 - DNA, 23 bp, Artificial Sequence
  Synthetic
ccgttttttttttttgaatataa

SEQ ID NO: 15986 - DNA, 23 bp, Artificial Sequence
  Synthetic
ccgttttttttttttaccaggtt

SEQ ID NO: 15987 - DNA, 23 bp, Artificial Sequence
  Synthetic
ccgttttttttttttacttagca

SEQ ID NO: 15988 - DNA, 23 bp, Artificial Sequence
  Synthetic
ccgttttttttttttgtggattt

SEQ ID NO: 15989 - DNA, 23 bp, Artificial Sequence
  Synthetic
ccgttttttttttttcatagaag

SEQ ID NO: 15990 - DNA, 23 bp, Artificial Sequence
  Synthetic
ccgttttttttttttgtggatgt

SEQ ID NO: 15991 - DNA, 23 bp, Artificial Sequence
  Synthetic
ccgttttttttttttaccataga

SEQ ID NO: 15992 - DNA, 23 bp, Artificial Sequence
  Synthetic
ccgttttttttttttgtgaaatt

SEQ ID NO: 15993 - DNA, 23 bp, Artificial Sequence
  Synthetic
ccgttttttttttttcaaaagtt

SEQ ID NO: 15994 - DNA, 23 bp, Artificial Sequence
  Synthetic
ccgttttttttttttcacaggac

SEQ ID NO: 15995 - DNA, 23 bp, Artificial Sequence
  Synthetic
ccgttttttttttttcgttccat

SEQ ID NO: 15996 - DNA, 23 bp, Artificial Sequence
  Synthetic
ccgttttttttttttagagcttg

SEQ ID NO: 15997 - DNA, 23 bp, Artificial Sequence
  Synthetic
ccgttttttttttttaatccacc

SEQ ID NO: 15998 - DNA, 23 bp, Artificial Sequence
  Synthetic
ccgttttttttttttagtgttgt

SEQ ID NO: 15999 - DNA, 23 bp, Artificial Sequence
  Synthetic
ccgttttttttttttgccacagt

SEQ ID NO: 16000 - DNA, 23 bp, Artificial Sequence
  Synthetic
ccgttttttttttttgggttcac

SEQ ID NO: 16001 - DNA, 23 bp, Artificial Sequence
  Synthetic
ccgttttttttttttaaagttgc

SEQ ID NO: 16002 - DNA, 23 bp, Artificial Sequence
  Synthetic
ccgttttttttttttcggctagt

SEQ ID NO: 16003 - DNA, 23 bp, Artificial Sequence
  Synthetic
ccgttttttttttttaacaaaca

SEQ ID NO: 16004 - DNA, 23 bp, Artificial Sequence
  Synthetic
ccgttttttttttttccttctga

SEQ ID NO: 16005 - DNA, 23 bp, Artificial Sequence
  Synthetic
ccgttttttttttttcaaaacat

SEQ ID NO: 16006 - DNA, 23 bp, Artificial Sequence
  Synthetic
ccgttttttttttttcggcatta

SEQ ID NO: 16007 - DNA, 23 bp, Artificial Sequence
  Synthetic
ccgttttttttttttcatgacgg

SEQ ID NO: 16008 - DNA, 23 bp, Artificial Sequence
  Synthetic
ccgttttttttttttcaccgagg

SEQ ID NO: 16009 - DNA, 23 bp, Artificial Sequence
  Synthetic
ccgttttttttttttgggacatc

SEQ ID NO: 16010 - DNA, 23 bp, Artificial Sequence
  Synthetic
ccgttttttttttttccagctaa

SEQ ID NO: 16011 - DNA, 23 bp, Artificial Sequence
  Synthetic
ccgttttttttttttattaggaa

SEQ ID NO: 16012 - DNA, 23 bp, Artificial Sequence
  Synthetic
ccgttttttttttttactcagta

SEQ ID NO: 16013 - DNA, 23 bp, Artificial Sequence
  Synthetic
ccgttttttttttttcaagacgg

SEQ ID NO: 16014 - DNA, 23 bp, Artificial Sequence
  Synthetic
ccgttttttttttttaattcatc

SEQ ID NO: 16015 - DNA, 23 bp, Artificial Sequence
  Synthetic
ccgttttttttttttgtggatga

SEQ ID NO: 16016 - DNA, 23 bp, Artificial Sequence
  Synthetic
ccgttttttttttttctgccata

SEQ ID NO: 16017 - DNA, 23 bp, Artificial Sequence
  Synthetic
ccgttttttttttttggcacaca

SEQ ID NO: 16018 - DNA, 23 bp, Artificial Sequence
  Synthetic
ccgttttttttttttggtttccc

SEQ ID NO: 16019 - DNA, 23 bp, Artificial Sequence
  Synthetic
ccgttttttttttttcaaaccac

SEQ ID NO: 16020 - DNA, 23 bp, Artificial Sequence
  Synthetic
ccgttttttttttttaacatcac

SEQ ID NO: 16021 - DNA, 23 bp, Artificial Sequence
  Synthetic
ccgttttttttttttacccaggg

SEQ ID NO: 16022 - DNA, 23 bp, Artificial Sequence
  Synthetic
ccgttttttttttttagtactgt

SEQ ID NO: 16023 - DNA, 23 bp, Artificial Sequence
  Synthetic
ccgttttttttttttgaaaccag

SEQ ID NO: 16024 - DNA, 23 bp, Artificial Sequence
  Synthetic
ccgttttttttttttcacaccaa

SEQ ID NO: 16025 - DNA, 23 bp, Artificial Sequence
  Synthetic
ccgttttttttttttcaggatcg

SEQ ID NO: 16026 - DNA, 23 bp, Artificial Sequence
  Synthetic
ccgttttttttttttgaccaaca

SEQ ID NO: 16027 - DNA, 23 bp, Artificial Sequence
  Synthetic
ccgttttttttttttagttatca

SEQ ID NO: 16028 - DNA, 23 bp, Artificial Sequence
  Synthetic
ccgttttttttttttgtgacatg

SEQ ID NO: 16029 - DNA, 23 bp, Artificial Sequence
  Synthetic
ccgttttttttttttgaagtgca

SEQ ID NO: 16030 - DNA, 23 bp, Artificial Sequence
  Synthetic
ccgttttttttttttggctgggg

SEQ ID NO: 16031 - DNA, 23 bp, Artificial Sequence
  Synthetic
ccgttttttttttttacaaaatc

SEQ ID NO: 16032 - DNA, 23 bp, Artificial Sequence
  Synthetic
ccgttttttttttttggcagact

SEQ ID NO: 16033 - DNA, 23 bp, Artificial Sequence
  Synthetic
ccgttttttttttttacaaaatc

SEQ ID NO: 16034 - DNA, 23 bp, Artificial Sequence
  Synthetic
ccgttttttttttttatacagct

SEQ ID NO: 16035 - DNA, 23 bp, Artificial Sequence
  Synthetic
ccgttttttttttttaggccggg

SEQ ID NO: 16036 - DNA, 23 bp, Artificial Sequence
  Synthetic
ccgttttttttttttacctgcac

SEQ ID NO: 16037 - DNA, 23 bp, Artificial Sequence
  Synthetic
ccgttttttttttttgcaaaaat

SEQ ID NO: 16038 - DNA, 23 bp, Artificial Sequence
  Synthetic
ccgttttttttttttacaataca

SEQ ID NO: 16039 - DNA, 23 bp, Artificial Sequence
  Synthetic
ccgttttttttttttacaagatc

SEQ ID NO: 16040 - DNA, 23 bp, Artificial Sequence
  Synthetic
ccgttttttttttttgcaaggtc

SEQ ID NO: 16041 - DNA, 23 bp, Artificial Sequence
  Synthetic
ccgttttttttttttgctcactc

SEQ ID NO: 16042 - DNA, 23 bp, Artificial Sequence
  Synthetic
ccgttttttttttttgctcactc

SEQ ID NO: 16043 - DNA, 23 bp, Artificial Sequence
  Synthetic
ccgttttttttttttgctcactc

SEQ ID NO: 16044 - DNA, 23 bp, Artificial Sequence
  Synthetic
ccgttttttttttttgctctctc

SEQ ID NO: 16045 - DNA, 23 bp, Artificial Sequence
  Synthetic
ccgttttttttttttgctcgctc

SEQ ID NO: 16046 - DNA, 23 bp, Artificial Sequence
  Synthetic
ccgttttttttttttagagctcc

SEQ ID NO: 16047 - DNA, 23 bp, Artificial Sequence
  Synthetic
ccgttttttttttttggagctcc

SEQ ID NO: 16048 - DNA, 23 bp, Artificial Sequence
  Synthetic
ccgttttttttttttgcatacag

SEQ ID NO: 16049 - DNA, 23 bp, Artificial Sequence
  Synthetic
ccgttttttttttttgcatacag

SEQ ID NO: 16050 - DNA, 23 bp, Artificial Sequence
  Synthetic
ccgttttttttttttgcatacag

SEQ ID NO: 16051 - DNA, 23 bp, Artificial Sequence
  Synthetic
ccgttttttttttttgcatacag

SEQ ID NO: 16052 - DNA, 23 bp, Artificial Sequence
  Synthetic
ccgttttttttttttgcatacag

SEQ ID NO: 16053 - DNA, 23 bp, Artificial Sequence
  Synthetic
ccgttttttttttttcacgtgcc

SEQ ID NO: 16054 - DNA, 23 bp, Artificial Sequence
  Synthetic
ccgttttttttttttgcacgtgc

SEQ ID NO: 16055 - DNA, 23 bp, Artificial Sequence
  Synthetic
ccgttttttttttttcacgtgtc

SEQ ID NO: 16056 - DNA, 23 bp, Artificial Sequence
  Synthetic
ccgttttttttttttggaatgaa

SEQ ID NO: 16057 - DNA, 23 bp, Artificial Sequence
  Synthetic
ccgttttttttttttggaatgaa

SEQ ID NO: 16058 - DNA, 23 bp, Artificial Sequence
  Synthetic
ccgttttttttttttggaatgaa

SEQ ID NO: 16059 - DNA, 23 bp, Artificial Sequence
  Synthetic
ccgttttttttttttggaatgaa

SEQ ID NO: 16060 - DNA, 23 bp, Artificial Sequence
  Synthetic
ccgttttttttttttgggattga

SEQ ID NO: 16061 - DNA, 23 bp, Artificial Sequence
  Synthetic
ccgttttttttttttaggaatga

SEQ ID NO: 16062 - DNA, 23 bp, Artificial Sequence
  Synthetic
ccgttttttttttttgggattga

SEQ ID NO: 16063 - DNA, 23 bp, Artificial Sequence
  Synthetic
ccgttttttttttttgatcatgc

SEQ ID NO: 16064 - DNA, 23 bp, Artificial Sequence
  Synthetic
ccgttttttttttttgatcatgc

SEQ ID NO: 16065 - DNA, 23 bp, Artificial Sequence
  Synthetic
ccgttttttttttttagatcatg

SEQ ID NO: 16066 - DNA, 23 bp, Artificial Sequence
  Synthetic
ccgttttttttttttagatcatg

SEQ ID NO: 16067 - DNA, 23 bp, Artificial Sequence
  Synthetic
ccgttttttttttttagatcatg

SEQ ID NO: 16068 - DNA, 23 bp, Artificial Sequence
  Synthetic
ccgttttttttttttagatcatg

SEQ ID NO: 16069 - DNA, 23 bp, Artificial Sequence
  Synthetic
ccgttttttttttttagatcatg

SEQ ID NO: 16070 - DNA, 23 bp, Artificial Sequence
  Synthetic
ccgttttttttttttcccgatct

SEQ ID NO: 16071 - DNA, 23 bp, Artificial Sequence
  Synthetic
ccgttttttttttttggcaagtc

SEQ ID NO: 16072 - DNA, 23 bp, Artificial Sequence
  Synthetic
ccgttttttttttttcggcaagt

SEQ ID NO: 16073 - DNA, 23 bp, Artificial Sequence
  Synthetic
ccgttttttttttttggcaagtc

SEQ ID NO: 16074 - DNA, 23 bp, Artificial Sequence
  Synthetic
ccgttttttttttttggcaagtc

SEQ ID NO: 16075 - DNA, 23 bp, Artificial Sequence
  Synthetic
ccgttttttttttttaggcaagt

SEQ ID NO: 16076 - DNA, 23 bp, Artificial Sequence
  Synthetic
ccgttttttttttttaggcaagt

SEQ ID NO: 16077 - DNA, 23 bp, Artificial Sequence
  Synthetic
ccgttttttttttttaggcaagt

SEQ ID NO: 16078 - DNA, 23 bp, Artificial Sequence
  Synthetic
ccgttttttttttttaggcaagt

SEQ ID NO: 16079 - DNA, 23 bp, Artificial Sequence
  Synthetic
ccgttttttttttttggcaagtc

SEQ ID NO: 16080 - DNA, 23 bp, Artificial Sequence
  Synthetic
ccgttttttttttttatattggc

SEQ ID NO: 16081 - DNA, 23 bp, Artificial Sequence
  Synthetic
ccgttttttttttttatattggc

SEQ ID NO: 16082 - DNA, 23 bp, Artificial Sequence
  Synthetic
ccgttttttttttttatattggc

SEQ ID NO: 16083 - DNA, 23 bp, Artificial Sequence
  Synthetic
ccgttttttttttttatattggc

SEQ ID NO: 16084 - DNA, 23 bp, Artificial Sequence
  Synthetic
ccgttttttttttttgtgatatt

SEQ ID NO: 16085 - DNA, 23 bp, Artificial Sequence
  Synthetic
ccgttttttttttttgtgatatt

SEQ ID NO: 16086 - DNA, 23 bp, Artificial Sequence
  Synthetic
ccgttttttttttttcagcatca

SEQ ID NO: 16087 - DNA, 23 bp, Artificial Sequence
  Synthetic
ccgttttttttttttcagcatca

SEQ ID NO: 16088 - DNA, 23 bp, Artificial Sequence
  Synthetic
ccgttttttttttttcagcatca

SEQ ID NO: 16089 - DNA, 23 bp, Artificial Sequence
  Synthetic
ccgttttttttttttcagcatca

SEQ ID NO: 16090 - DNA, 23 bp, Artificial Sequence
  Synthetic
ccgttttttttttttgcagcatc

SEQ ID NO: 16091 - DNA, 23 bp, Artificial Sequence
  Synthetic
ccgttttttttttttggagcacc

SEQ ID NO: 16092 - DNA, 23 bp, Artificial Sequence
  Synthetic
ccgttttttttttttatcaatgc

SEQ ID NO: 16093 - DNA, 23 bp, Artificial Sequence
  Synthetic
ccgttttttttttttgaggtgga

SEQ ID NO: 16094 - DNA, 23 bp, Artificial Sequence
  Synthetic
ccgttttttttttttgaggtgga

SEQ ID NO: 16095 - DNA, 23 bp, Artificial Sequence
  Synthetic
ccgttttttttttttagttcccc

SEQ ID NO: 16096 - DNA, 23 bp, Artificial Sequence
  Synthetic
ccgttttttttttttagttcccc

SEQ ID NO: 16097 - DNA, 23 bp, Artificial Sequence
  Synthetic
ccgttttttttttttagttcccc

SEQ ID NO: 16098 - DNA, 23 bp, Artificial Sequence
  Synthetic
ccgttttttttttttagttcccc

SEQ ID NO: 16099 - DNA, 23 bp, Artificial Sequence
  Synthetic
ccgttttttttttttagttcccc

SEQ ID NO: 16100 - DNA, 23 bp, Artificial Sequence
  Synthetic
ccgttttttttttttagttcccc

SEQ ID NO: 16101 - DNA, 23 bp, Artificial Sequence
  Synthetic
ccgttttttttttttagttcaag

SEQ ID NO: 16102 - DNA, 23 bp, Artificial Sequence
  Synthetic
ccgttttttttttttagttcaag

SEQ ID NO: 16103 - DNA, 23 bp, Artificial Sequence
  Synthetic
ccgttttttttttttagttcaag

SEQ ID NO: 16104 - DNA, 23 bp, Artificial Sequence
  Synthetic
ccgttttttttttttagggcaat

SEQ ID NO: 16105 - DNA, 23 bp, Artificial Sequence
  Synthetic
ccgttttttttttttagggcagc

SEQ ID NO: 16106 - DNA, 23 bp, Artificial Sequence
  Synthetic
ccgttttttttttttagggcaat

SEQ ID NO: 16107 - DNA, 23 bp, Artificial Sequence
  Synthetic
ccgttttttttttttagggcaac

SEQ ID NO: 16108 - DNA, 23 bp, Artificial Sequence
  Synthetic
ccgttttttttttttgggcaaat

SEQ ID NO: 16109 - DNA, 23 bp, Artificial Sequence
  Synthetic
ccgttttttttttttgggcaaat

SEQ ID NO: 16110 - DNA, 23 bp, Artificial Sequence
  Synthetic
ccgttttttttttttggggcaaa

SEQ ID NO: 16111 - DNA, 23 bp, Artificial Sequence
  Synthetic
ccgttttttttttttagggcaat

SEQ ID NO: 16112 - DNA, 23 bp, Artificial Sequence
  Synthetic
ccgttttttttttttagggcaac

SEQ ID NO: 16113 - DNA, 23 bp, Artificial Sequence
  Synthetic
ccgttttttttttttacaagttc

SEQ ID NO: 16114 - DNA, 23 bp, Artificial Sequence
  Synthetic
ccgttttttttttttcagttatc

SEQ ID NO: 16115 - DNA, 23 bp, Artificial Sequence
  Synthetic
ccgttttttttttttcaggagtc

SEQ ID NO: 16116 - DNA, 23 bp, Artificial Sequence
  Synthetic
ccgttttttttttttctacctgc

SEQ ID NO: 16117 - DNA, 23 bp, Artificial Sequence
  Synthetic
ccgttttttttttttctgcactg

SEQ ID NO: 16118 - DNA, 23 bp, Artificial Sequence
  Synthetic
ccgttttttttttttacaaattc

SEQ ID NO: 16119 - DNA, 23 bp, Artificial Sequence
  Synthetic
ccgttttttttttttacaagtta

SEQ ID NO: 16120 - DNA, 23 bp, Artificial Sequence
  Synthetic
ccgttttttttttttgccaagct

SEQ ID NO: 16121 - DNA, 23 bp, Artificial Sequence
  Synthetic
ccgttttttttttttaaagagac

SEQ ID NO: 16122 - DNA, 23 bp, Artificial Sequence
  Synthetic
ccgttttttttttttcagctggt

SEQ ID NO: 16123 - DNA, 23 bp, Artificial Sequence
  Synthetic
ccgttttttttttttcagaagca

SEQ ID NO: 16124 - DNA, 23 bp, Artificial Sequence
  Synthetic
ccgttttttttttttacaaacca

SEQ ID NO: 16125 - DNA, 23 bp, Artificial Sequence
  Synthetic
ccgttttttttttttgccaatat

SEQ ID NO: 16126 - DNA, 23 bp, Artificial Sequence
  Synthetic
ccgttttttttttttcaagtgcc

SEQ ID NO: 16127 - DNA, 23 bp, Artificial Sequence
  Synthetic
ccgttttttttttttctacctgc

SEQ ID NO: 16128 - DNA, 23 bp, Artificial Sequence
  Synthetic
ccgttttttttttttctgcacta

SEQ ID NO: 16129 - DNA, 23 bp, Artificial Sequence
  Synthetic
ccgttttttttttttctcaccga

SEQ ID NO: 16130 - DNA, 23 bp, Artificial Sequence
  Synthetic
ccgttttttttttttagtgaatt

SEQ ID NO: 16131 - DNA, 23 bp, Artificial Sequence
  Synthetic
ccgttttttttttttgagctccc

SEQ ID NO: 16132 - DNA, 23 bp, Artificial Sequence
  Synthetic
ccgttttttttttttaacaggta

SEQ ID NO: 16133 - DNA, 23 bp, Artificial Sequence
  Synthetic
ccgttttttttttttagttttgc

SEQ ID NO: 16134 - DNA, 23 bp, Artificial Sequence
  Synthetic
ccgttttttttttttagttttgc

SEQ ID NO: 16135 - DNA, 23 bp, Artificial Sequence
  Synthetic
ccgttttttttttttcctgcact

SEQ ID NO: 16136 - DNA, 23 bp, Artificial Sequence
  Synthetic
ccgttttttttttttggcatagg

SEQ ID NO: 16137 - DNA, 23 bp, Artificial Sequence
  Synthetic
ccgttttttttttttgcctgtct

SEQ ID NO: 16138 - DNA, 23 bp, Artificial Sequence
  Synthetic
ccgttttttttttttcatggtta

SEQ ID NO: 16139 - DNA, 23 bp, Artificial Sequence
  Synthetic
ccgttttttttttttcagttctt

SEQ ID NO: 16140 - DNA, 23 bp, Artificial Sequence
  Synthetic
ccgttttttttttttgggtattt

SEQ ID NO: 16141 - DNA, 23 bp, Artificial Sequence
  Synthetic
ccgttttttttttttgaaatccc

SEQ ID NO: 16142 - DNA, 23 bp, Artificial Sequence
  Synthetic
ccgttttttttttttgcggaact

SEQ ID NO: 16143 - DNA, 23 bp, Artificial Sequence
  Synthetic
ccgttttttttttttcaatagac

SEQ ID NO: 16144 - DNA, 23 bp, Artificial Sequence
  Synthetic
ccgttttttttttttaccgattt

SEQ ID NO: 16145 - DNA, 23 bp, Artificial Sequence
  Synthetic
ccgttttttttttttctgatttc

SEQ ID NO: 16146 - DNA, 23 bp, Artificial Sequence
  Synthetic
ccgttttttttttttcaacttag

SEQ ID NO: 16147 - DNA, 23 bp, Artificial Sequence
  Synthetic
ccgttttttttttttcaaccagc

SEQ ID NO: 16148 - DNA, 23 bp, Artificial Sequence
  Synthetic
ccgttttttttttttacaaaatc

SEQ ID NO: 16149 - DNA, 23 bp, Artificial Sequence
  Synthetic
ccgttttttttttttcaggccgg

SEQ ID NO: 16150 - DNA, 23 bp, Artificial Sequence
  Synthetic
ccgttttttttttttacctgcac

SEQ ID NO: 16151 - DNA, 23 bp, Artificial Sequence
  Synthetic
ccgttttttttttttctcaataa

SEQ ID NO: 16152 - DNA, 23 bp, Artificial Sequence
  Synthetic
ccgttttttttttttcaaaaatg

SEQ ID NO: 16153 - DNA, 23 bp, Artificial Sequence
  Synthetic
ccgttttttttttttcagctttc

SEQ ID NO: 16154 - DNA, 23 bp, Artificial Sequence
  Synthetic
ccgttttttttttttcagctttc

SEQ ID NO: 16155 - DNA, 23 bp, Artificial Sequence
  Synthetic
ccgttttttttttttaaagcttt

SEQ ID NO: 16156 - DNA, 23 bp, Artificial Sequence
  Synthetic
ccgttttttttttttgtcatcca

SEQ ID NO: 16157 - DNA, 23 bp, Artificial Sequence
  Synthetic
ccgttttttttttttgtcatcca

SEQ ID NO: 16158 - DNA, 23 bp, Artificial Sequence
  Synthetic
ccgttttttttttttagaagaca

SEQ ID NO: 16159 - DNA, 23 bp, Artificial Sequence
  Synthetic
ccgttttttttttttaccttttg

SEQ ID NO: 16160 - DNA, 23 bp, Artificial Sequence
  Synthetic
ccgttttttttttttcacagtcg

SEQ ID NO: 16161 - DNA, 23 bp, Artificial Sequence
  Synthetic
ccgttttttttttttaaactcgg

SEQ ID NO: 16162 - DNA, 23 bp, Artificial Sequence
  Synthetic
ccgttttttttttttaccttgaa

SEQ ID NO: 16163 - DNA, 23 bp, Artificial Sequence
  Synthetic
ccgttttttttttttgactcctg

SEQ ID NO: 16164 - DNA, 23 bp, Artificial Sequence
  Synthetic
ccgttttttttttttagcattca

SEQ ID NO: 16165 - DNA, 23 bp, Artificial Sequence
  Synthetic
ccgttttttttttttagcattca

SEQ ID NO: 16166 - DNA, 23 bp, Artificial Sequence
  Synthetic
ccgttttttttttttgcattcac

SEQ ID NO: 16167 - DNA, 23 bp, Artificial Sequence
  Synthetic
ccgttttttttttttcaaaggtc

SEQ ID NO: 16168 - DNA, 23 bp, Artificial Sequence
  Synthetic
ccgttttttttttttgcagtcaa

SEQ ID NO: 16169 - DNA, 23 bp, Artificial Sequence
  Synthetic
ccgttttttttttttcctgatac

SEQ ID NO: 16170 - DNA, 23 bp, Artificial Sequence
  Synthetic
ccgttttttttttttggcatatt

SEQ ID NO: 16171 - DNA, 23 bp, Artificial Sequence
  Synthetic
ccgttttttttttttctctttag

SEQ ID NO: 16172 - DNA, 23 bp, Artificial Sequence
  Synthetic
ccgttttttttttttctggttga

SEQ ID NO: 16173 - DNA, 23 bp, Artificial Sequence
  Synthetic
ccgttttttttttttcttagcaa

SEQ ID NO: 16174 - DNA, 23 bp, Artificial Sequence
  Synthetic
ccgttttttttttttaccaatta

SEQ ID NO: 16175 - DNA, 23 bp, Artificial Sequence
  Synthetic
ccgttttttttttttgatatgct

SEQ ID NO: 16176 - DNA, 23 bp, Artificial Sequence
  Synthetic
ccgttttttttttttaccaataa

SEQ ID NO: 16177 - DNA, 23 bp, Artificial Sequence
  Synthetic
ccgttttttttttttcacgatac

SEQ ID NO: 16178 - DNA, 23 bp, Artificial Sequence
  Synthetic
ccgttttttttttttgcatattt

SEQ ID NO: 16179 - DNA, 23 bp, Artificial Sequence
  Synthetic
ccgttttttttttttaccataat

SEQ ID NO: 16180 - DNA, 23 bp, Artificial Sequence
  Synthetic
ccgttttttttttttacactatt

SEQ ID NO: 16181 - DNA, 23 bp, Artificial Sequence
  Synthetic
ccgttttttttttttagaactgc

SEQ ID NO: 16182 - DNA, 23 bp, Artificial Sequence
  Synthetic
ccgttttttttttttcatatccg

SEQ ID NO: 16183 - DNA, 23 bp, Artificial Sequence
  Synthetic
ccgttttttttttttggccagat

SEQ ID NO: 16184 - DNA, 23 bp, Artificial Sequence
  Synthetic
ccgttttttttttttaagctgca

SEQ ID NO: 16185 - DNA, 23 bp, Artificial Sequence
  Synthetic
ccgttttttttttttcataccag

SEQ ID NO: 16186 - DNA, 23 bp, Artificial Sequence
  Synthetic
ccgttttttttttttggccagat

SEQ ID NO: 16187 - DNA, 23 bp, Artificial Sequence
  Synthetic
ccgttttttttttttgaatgtta

SEQ ID NO: 16188 - DNA, 23 bp, Artificial Sequence
  Synthetic
ccgttttttttttttaagagcat

SEQ ID NO: 16189 - DNA, 23 bp, Artificial Sequence
  Synthetic
ccgttttttttttttcctcatga

SEQ ID NO: 16190 - DNA, 23 bp, Artificial Sequence
  Synthetic
ccgttttttttttttgcgttcca

SEQ ID NO: 16191 - DNA, 23 bp, Artificial Sequence
  Synthetic
ccgttttttttttttatcacaac

SEQ ID NO: 16192 - DNA, 23 bp, Artificial Sequence
  Synthetic
ccgttttttttttttctcatcaa

SEQ ID NO: 16193 - DNA, 23 bp, Artificial Sequence
  Synthetic
ccgttttttttttttgacaacca

SEQ ID NO: 16194 - DNA, 23 bp, Artificial Sequence
  Synthetic
ccgttttttttttttgatcatca

SEQ ID NO: 16195 - DNA, 23 bp, Artificial Sequence
  Synthetic
ccgttttttttttttgacatcaa

SEQ ID NO: 16196 - DNA, 23 bp, Artificial Sequence
  Synthetic
ccgttttttttttttagttatgc

SEQ ID NO: 16197 - DNA, 23 bp, Artificial Sequence
  Synthetic
ccgttttttttttttagctatgc

SEQ ID NO: 16198 - DNA, 23 bp, Artificial Sequence
  Synthetic
ccgttttttttttttatgaatgt

SEQ ID NO: 16199 - DNA, 23 bp, Artificial Sequence
  Synthetic
ccgttttttttttttaaccaagt

SEQ ID NO: 16200 - DNA, 23 bp, Artificial Sequence
  Synthetic
ccgttttttttttttcagtaagt

SEQ ID NO: 16201 - DNA, 23 bp, Artificial Sequence
  Synthetic
ccgttttttttttttccctcgtt

SEQ ID NO: 16202 - DNA, 23 bp, Artificial Sequence
  Synthetic
ccgttttttttttttctcactac

SEQ ID NO: 16203 - DNA, 23 bp, Artificial Sequence
  Synthetic
ccgttttttttttttcccactac

SEQ ID NO: 16204 - DNA, 23 bp, Artificial Sequence
  Synthetic
ccgttttttttttttgaaaaaca

SEQ ID NO: 16205 - DNA, 23 bp, Artificial Sequence
  Synthetic
ccgttttttttttttctcactac

SEQ ID NO: 16206 - DNA, 23 bp, Artificial Sequence
  Synthetic
ccgttttttttttttcacagctc

SEQ ID NO: 16207 - DNA, 23 bp, Artificial Sequence
  Synthetic
ccgttttttttttttcccgatat

SEQ ID NO: 16208 - DNA, 23 bp, Artificial Sequence
  Synthetic
ccgttttttttttttcttcaatt

SEQ ID NO: 16209 - DNA, 23 bp, Artificial Sequence
  Synthetic
ccgttttttttttttcattacac

SEQ ID NO: 16210 - DNA, 23 bp, Artificial Sequence
  Synthetic
ccgttttttttttttccaccgag

SEQ ID NO: 16211 - DNA, 23 bp, Artificial Sequence
  Synthetic
ccgttttttttttttgaactgga

SEQ ID NO: 16212 - DNA, 23 bp, Artificial Sequence
  Synthetic
ccgttttttttttttcatggcca

SEQ ID NO: 16213 - DNA, 23 bp, Artificial Sequence
  Synthetic
ccgttttttttttttaaccacca

SEQ ID NO: 16214 - DNA, 23 bp, Artificial Sequence
  Synthetic
ccgttttttttttttagatcaca

SEQ ID NO: 16215 - DNA, 23 bp, Artificial Sequence
  Synthetic
ccgttttttttttttgtaataac

SEQ ID NO: 16216 - DNA, 23 bp, Artificial Sequence
  Synthetic
ccgttttttttttttgtgaaata

SEQ ID NO: 16217 - DNA, 23 bp, Artificial Sequence
  Synthetic
ccgttttttttttttatccaaat

SEQ ID NO: 16218 - DNA, 23 bp, Artificial Sequence
  Synthetic
ccgttttttttttttcactttgg

SEQ ID NO: 16219 - DNA, 23 bp, Artificial Sequence
  Synthetic
ccgttttttttttttaactaaat

SEQ ID NO: 16220 - DNA, 23 bp, Artificial Sequence
  Synthetic
ccgttttttttttttcaacgaaa

SEQ ID NO: 16221 - DNA, 23 bp, Artificial Sequence
  Synthetic
ccgttttttttttttagcaaatc

SEQ ID NO: 16222 - DNA, 23 bp, Artificial Sequence
  Synthetic
ccgttttttttttttgcatcgtt

SEQ ID NO: 16223 - DNA, 23 bp, Artificial Sequence
  Synthetic
ccgttttttttttttcacttgaa

SEQ ID NO: 16224 - DNA, 23 bp, Artificial Sequence
  Synthetic
ccgttttttttttttcatttgaa

SEQ ID NO: 16225 - DNA, 23 bp, Artificial Sequence
  Synthetic
ccgttttttttttttataattaa

SEQ ID NO: 16226 - DNA, 23 bp, Artificial Sequence
  Synthetic
ccgttttttttttttgctcactc

SEQ ID NO: 16227 - DNA, 23 bp, Artificial Sequence
  Synthetic
ccgttttttttttttagagctcc

SEQ ID NO: 16228 - DNA, 23 bp, Artificial Sequence
  Synthetic
ccgttttttttttttagagctcc

SEQ ID NO: 16229 - DNA, 23 bp, Artificial Sequence
  Synthetic
ccgttttttttttttggagctcc

SEQ ID NO: 16230 - DNA, 23 bp, Artificial Sequence
  Synthetic
ccgttttttttttttagagctcc

SEQ ID NO: 16231 - DNA, 23 bp, Artificial Sequence
  Synthetic
ccgttttttttttttagagctcc

SEQ ID NO: 16232 - DNA, 23 bp, Artificial Sequence
  Synthetic
ccgttttttttttttagatcatg

SEQ ID NO: 16233 - DNA, 23 bp, Artificial Sequence
  Synthetic
ccgttttttttttttagatcatg

SEQ ID NO: 16234 - DNA, 23 bp, Artificial Sequence
  Synthetic
ccgttttttttttttcccgatct

SEQ ID NO: 16235 - DNA, 23 bp, Artificial Sequence
  Synthetic
ccgttttttttttttcccgatct

SEQ ID NO: 16236 - DNA, 23 bp, Artificial Sequence
  Synthetic
ccgttttttttttttagttcaag

SEQ ID NO: 16237 - DNA, 23 bp, Artificial Sequence
  Synthetic
ccgttttttttttttccagggaa

SEQ ID NO: 16238 - DNA, 23 bp, Artificial Sequence
  Synthetic
ccgttttttttttttccagggaa

SEQ ID NO: 16239 - DNA, 23 bp, Artificial Sequence
  Synthetic
ccgttttttttttttccagggaa

SEQ ID NO: 16240 - DNA, 23 bp, Artificial Sequence
  Synthetic
ccgttttttttttttccagggaa

SEQ ID NO: 16241 - DNA, 23 bp, Artificial Sequence
  Synthetic
ccgttttttttttttccagggaa

SEQ ID NO: 16242 - DNA, 23 bp, Artificial Sequence
  Synthetic
ccgttttttttttttaccataca

SEQ ID NO: 16243 - DNA, 23 bp, Artificial Sequence
  Synthetic
ccgttttttttttttactataca

SEQ ID NO: 16244 - DNA, 23 bp, Artificial Sequence
  Synthetic
ccgttttttttttttgcacaaac

SEQ ID NO: 16245 - DNA, 23 bp, Artificial Sequence
  Synthetic
ccgttttttttttttatagccct

SEQ ID NO: 16246 - DNA, 23 bp, Artificial Sequence
  Synthetic
ccgttttttttttttcaggagtc

SEQ ID NO: 16247 - DNA, 23 bp, Artificial Sequence
  Synthetic
ccgttttttttttttaaggagtc

SEQ ID NO: 16248 - DNA, 23 bp, Artificial Sequence
  Synthetic
ccgttttttttttttctacctgc

SEQ ID NO: 16249 - DNA, 23 bp, Artificial Sequence
  Synthetic
ccgttttttttttttatagccct

SEQ ID NO: 16250 - DNA, 23 bp, Artificial Sequence
  Synthetic
ccgttttttttttttcaaacacc

SEQ ID NO: 16251 - DNA, 23 bp, Artificial Sequence
  Synthetic
ccgttttttttttttgcattcac

SEQ ID NO: 16252 - DNA, 23 bp, Artificial Sequence
  Synthetic
ccgttttttttttttacaagtta

SEQ ID NO: 16253 - DNA, 23 bp, Artificial Sequence
  Synthetic
ccgttttttttttttaaagagac

SEQ ID NO: 16254 - DNA, 23 bp, Artificial Sequence
  Synthetic
ccgttttttttttttacatagga

SEQ ID NO: 16255 - DNA, 23 bp, Artificial Sequence
  Synthetic
ccgttttttttttttcatcatca

SEQ ID NO: 16256 - DNA, 23 bp, Artificial Sequence
  Synthetic
ccgttttttttttttgacacgtg

SEQ ID NO: 16257 - DNA, 23 bp, Artificial Sequence
  Synthetic
ccgttttttttttttaccatagg

SEQ ID NO: 16258 - DNA, 23 bp, Artificial Sequence
  Synthetic
ccgttttttttttttagggattc

SEQ ID NO: 16259 - DNA, 23 bp, Artificial Sequence
  Synthetic
ccgttttttttttttcaaagttc

SEQ ID NO: 16260 - DNA, 23 bp, Artificial Sequence
  Synthetic
ccgttttttttttttacttttgt

SEQ ID NO: 16261 - DNA, 23 bp, Artificial Sequence
  Synthetic
ccgttttttttttttaaaccatg

SEQ ID NO: 16262 - DNA, 23 bp, Artificial Sequence
  Synthetic
ccgttttttttttttctgcacta

SEQ ID NO: 16263 - DNA, 23 bp, Artificial Sequence
  Synthetic
ccgttttttttttttacccaccg

SEQ ID NO: 16264 - DNA, 23 bp, Artificial Sequence
  Synthetic
ccgttttttttttttctcaccga

SEQ ID NO: 16265 - DNA, 23 bp, Artificial Sequence
  Synthetic
ccgttttttttttttagtgaatt

SEQ ID NO: 16266 - DNA, 23 bp, Artificial Sequence
  Synthetic
ccgttttttttttttcccttatc

SEQ ID NO: 16267 - DNA, 23 bp, Artificial Sequence
  Synthetic
ccgttttttttttttagcccaaa

SEQ ID NO: 16268 - DNA, 23 bp, Artificial Sequence
  Synthetic
ccgttttttttttttcaacaaca

SEQ ID NO: 16269 - DNA, 23 bp, Artificial Sequence
  Synthetic
ccgttttttttttttagttttgc

SEQ ID NO: 16270 - DNA, 23 bp, Artificial Sequence
  Synthetic
ccgttttttttttttcctgcact

SEQ ID NO: 16271 - DNA, 23 bp, Artificial Sequence
  Synthetic
ccgttttttttttttggcatagg

SEQ ID NO: 16272 - DNA, 23 bp, Artificial Sequence
  Synthetic
ccgttttttttttttagactccg

SEQ ID NO: 16273 - DNA, 23 bp, Artificial Sequence
  Synthetic
ccgttttttttttttaacatcag

SEQ ID NO: 16274 - DNA, 23 bp, Artificial Sequence
  Synthetic
ccgttttttttttttgcctgtct

SEQ ID NO: 16275 - DNA, 23 bp, Artificial Sequence
  Synthetic
ccgttttttttttttacagttgc

SEQ ID NO: 16276 - DNA, 23 bp, Artificial Sequence
  Synthetic
ccgttttttttttttccaatcag

SEQ ID NO: 16277 - DNA, 23 bp, Artificial Sequence
  Synthetic
ccgttttttttttttaacggaac

SEQ ID NO: 16278 - DNA, 23 bp, Artificial Sequence
  Synthetic
ccgttttttttttttgaaatccc

SEQ ID NO: 16279 - DNA, 23 bp, Artificial Sequence
  Synthetic
ccgttttttttttttgttcctgc

SEQ ID NO: 16280 - DNA, 23 bp, Artificial Sequence
  Synthetic
ccgttttttttttttgcctatcc

SEQ ID NO: 16281 - DNA, 23 bp, Artificial Sequence
  Synthetic
ccgttttttttttttcggaactt

SEQ ID NO: 16282 - DNA, 23 bp, Artificial Sequence
  Synthetic
ccgttttttttttttcaatagag

SEQ ID NO: 16283 - DNA, 23 bp, Artificial Sequence
  Synthetic
ccgttttttttttttctgatttc

SEQ ID NO: 16284 - DNA, 23 bp, Artificial Sequence
  Synthetic
ccgttttttttttttaccgattt

SEQ ID NO: 16285 - DNA, 23 bp, Artificial Sequence
  Synthetic
ccgttttttttttttctttgaca

SEQ ID NO: 16286 - DNA, 23 bp, Artificial Sequence
  Synthetic
ccgttttttttttttctgagagt

SEQ ID NO: 16287 - DNA, 23 bp, Artificial Sequence
  Synthetic
ccgttttttttttttcaacttag

SEQ ID NO: 16288 - DNA, 23 bp, Artificial Sequence
  Synthetic
ccgttttttttttttgaggtcga

SEQ ID NO: 16289 - DNA, 23 bp, Artificial Sequence
  Synthetic
ccgttttttttttttcacttact

SEQ ID NO: 16290 - DNA, 23 bp, Artificial Sequence
  Synthetic
ccgttttttttttttggaggaag

SEQ ID NO: 16291 - DNA, 23 bp, Artificial Sequence
  Synthetic
ccgttttttttttttacaaaatc

SEQ ID NO: 16292 - DNA, 23 bp, Artificial Sequence
  Synthetic
ccgttttttttttttatacagct

SEQ ID NO: 16293 - DNA, 23 bp, Artificial Sequence
  Synthetic
ccgttttttttttttatacagct

SEQ ID NO: 16294 - DNA, 23 bp, Artificial Sequence
  Synthetic
ccgttttttttttttctcaataa

SEQ ID NO: 16295 - DNA, 23 bp, Artificial Sequence
  Synthetic
ccgttttttttttttctcagggc

SEQ ID NO: 16296 - DNA, 23 bp, Artificial Sequence
  Synthetic
ccgttttttttttttaggctcat

SEQ ID NO: 16297 - DNA, 23 bp, Artificial Sequence
  Synthetic
ccgttttttttttttactataca

SEQ ID NO: 16298 - DNA, 23 bp, Artificial Sequence
  Synthetic
ccgttttttttttttaccacaca

SEQ ID NO: 16299 - DNA, 23 bp, Artificial Sequence
  Synthetic
ccgttttttttttttaccataca

SEQ ID NO: 16300 - DNA, 23 bp, Artificial Sequence
  Synthetic
ccgttttttttttttactattca

SEQ ID NO: 16301 - DNA, 23 bp, Artificial Sequence
  Synthetic
ccgttttttttttttactataca

SEQ ID NO: 16302 - DNA, 23 bp, Artificial Sequence
  Synthetic
ccgttttttttttttacaacaca

SEQ ID NO: 16303 - DNA, 23 bp, Artificial Sequence
  Synthetic
ccgttttttttttttacagcaca

SEQ ID NO: 16304 - DNA, 23 bp, Artificial Sequence
  Synthetic
ccgttttttttttttactgtaca

SEQ ID NO: 16305 - DNA, 23 bp, Artificial Sequence
  Synthetic
ccgttttttttttttacatactt

SEQ ID NO: 16306 - DNA, 23 bp, Artificial Sequence
  Synthetic
ccgttttttttttttacaagttc

SEQ ID NO: 16307 - DNA, 23 bp, Artificial Sequence
  Synthetic
ccgttttttttttttcagttatc

SEQ ID NO: 16308 - DNA, 23 bp, Artificial Sequence
  Synthetic
ccgttttttttttttcagttatc

SEQ ID NO: 16309 - DNA, 23 bp, Artificial Sequence
  Synthetic
ccgttttttttttttatagccct

SEQ ID NO: 16310 - DNA, 23 bp, Artificial Sequence
  Synthetic
ccgttttttttttttatagccct

SEQ ID NO: 16311 - DNA, 23 bp, Artificial Sequence
  Synthetic
ccgttttttttttttacaaattc

SEQ ID NO: 16312 - DNA, 23 bp, Artificial Sequence
  Synthetic
ccgttttttttttttcaaatccg

SEQ ID NO: 16313 - DNA, 23 bp, Artificial Sequence
  Synthetic
ccgttttttttttttacacacat

SEQ ID NO: 16314 - DNA, 23 bp, Artificial Sequence
  Synthetic
ccgttttttttttttaaacacca

SEQ ID NO: 16315 - DNA, 23 bp, Artificial Sequence
  Synthetic
ccgttttttttttttgcattcac

SEQ ID NO: 16316 - DNA, 23 bp, Artificial Sequence
  Synthetic
ccgttttttttttttacaggtta

SEQ ID NO: 16317 - DNA, 23 bp, Artificial Sequence
  Synthetic
ccgttttttttttttacaagtta

SEQ ID NO: 16318 - DNA, 23 bp, Artificial Sequence
  Synthetic
ccgttttttttttttcattatta

SEQ ID NO: 16319 - DNA, 23 bp, Artificial Sequence
  Synthetic
ccgttttttttttttaaagagac

SEQ ID NO: 16320 - DNA, 23 bp, Artificial Sequence
  Synthetic
ccgttttttttttttgcaagccc

SEQ ID NO: 16321 - DNA, 23 bp, Artificial Sequence
  Synthetic
ccgttttttttttttgccctttt

SEQ ID NO: 16322 - DNA, 23 bp, Artificial Sequence
  Synthetic
ccgttttttttttttgaccatgg

SEQ ID NO: 16323 - DNA, 23 bp, Artificial Sequence
  Synthetic
ccgttttttttttttagctggtt

SEQ ID NO: 16324 - DNA, 23 bp, Artificial Sequence
  Synthetic
ccgttttttttttttacatagga

SEQ ID NO: 16325 - DNA, 23 bp, Artificial Sequence
  Synthetic
ccgttttttttttttagatagga

SEQ ID NO: 16326 - DNA, 23 bp, Artificial Sequence
  Synthetic
ccgttttttttttttcgcgtatt

SEQ ID NO: 16327 - DNA, 23 bp, Artificial Sequence
  Synthetic
ccgttttttttttttgcctgatt

SEQ ID NO: 16328 - DNA, 23 bp, Artificial Sequence
  Synthetic
ccgttttttttttttaccatagg

SEQ ID NO: 16329 - DNA, 23 bp, Artificial Sequence
  Synthetic
ccgttttttttttttgtagtgct

SEQ ID NO: 16330 - DNA, 23 bp, Artificial Sequence
  Synthetic
ccgttttttttttttgtagtgct

SEQ ID NO: 16331 - DNA, 23 bp, Artificial Sequence
  Synthetic
ccgttttttttttttgtacatca

SEQ ID NO: 16332 - DNA, 23 bp, Artificial Sequence
  Synthetic
ccgttttttttttttcaaagttc

SEQ ID NO: 16333 - DNA, 23 bp, Artificial Sequence
  Synthetic
ccgttttttttttttcaaagttc

SEQ ID NO: 16334 - DNA, 23 bp, Artificial Sequence
  Synthetic
ccgttttttttttttatcacttt

SEQ ID NO: 16335 - DNA, 23 bp, Artificial Sequence
  Synthetic
ccgttttttttttttctcatttt

SEQ ID NO: 16336 - DNA, 23 bp, Artificial Sequence
  Synthetic
ccgttttttttttttacaaacca

SEQ ID NO: 16337 - DNA, 23 bp, Artificial Sequence
  Synthetic
ccgttttttttttttcaaaccat

SEQ ID NO: 16338 - DNA, 23 bp, Artificial Sequence
  Synthetic
ccgttttttttttttccaatatt

SEQ ID NO: 16339 - DNA, 23 bp, Artificial Sequence
  Synthetic
ccgttttttttttttcctgcact

SEQ ID NO: 16340 - DNA, 23 bp, Artificial Sequence
  Synthetic
ccgttttttttttttctgcacta

SEQ ID NO: 16341 - DNA, 23 bp, Artificial Sequence
  Synthetic
ccgttttttttttttctcaccga

SEQ ID NO: 16342 - DNA, 23 bp, Artificial Sequence
  Synthetic
ccgttttttttttttgtacaatc

SEQ ID NO: 16343 - DNA, 23 bp, Artificial Sequence
  Synthetic
ccgttttttttttttccaccgac

SEQ ID NO: 16344 - DNA, 23 bp, Artificial Sequence
  Synthetic
ccgttttttttttttgttggcaa

SEQ ID NO: 16345 - DNA, 23 bp, Artificial Sequence
  Synthetic
ccgttttttttttttagtgaatt

SEQ ID NO: 16346 - DNA, 23 bp, Artificial Sequence
  Synthetic
ccgttttttttttttccttatca

SEQ ID NO: 16347 - DNA, 23 bp, Artificial Sequence
  Synthetic
ccgttttttttttttgctgcaac

SEQ ID NO: 16348 - DNA, 23 bp, Artificial Sequence
  Synthetic
ccgttttttttttttcctaatat

SEQ ID NO: 16349 - DNA, 23 bp, Artificial Sequence
  Synthetic
ccgttttttttttttgctgtcaa

SEQ ID NO: 16350 - DNA, 23 bp, Artificial Sequence
  Synthetic
ccgttttttttttttctgggact

SEQ ID NO: 16351 - DNA, 23 bp, Artificial Sequence
  Synthetic
ccgttttttttttttcacatgga

SEQ ID NO: 16352 - DNA, 23 bp, Artificial Sequence
  Synthetic
ccgttttttttttttccaacaac

SEQ ID NO: 16353 - DNA, 23 bp, Artificial Sequence
  Synthetic
ccgttttttttttttccaacaac

SEQ ID NO: 16354 - DNA, 23 bp, Artificial Sequence
  Synthetic
ccgttttttttttttaacaggta

SEQ ID NO: 16355 - DNA, 23 bp, Artificial Sequence
  Synthetic
ccgttttttttttttagttttgc

SEQ ID NO: 16356 - DNA, 23 bp, Artificial Sequence
  Synthetic
ccgttttttttttttagttttgc

SEQ ID NO: 16357 - DNA, 23 bp, Artificial Sequence
  Synthetic
ccgttttttttttttacctgcac

SEQ ID NO: 16358 - DNA, 23 bp, Artificial Sequence
  Synthetic
ccgttttttttttttcatcgtta

SEQ ID NO: 16359 - DNA, 23 bp, Artificial Sequence
  Synthetic
ccgttttttttttttatcattac

SEQ ID NO: 16360 - DNA, 23 bp, Artificial Sequence
  Synthetic
ccgttttttttttttccatgccc

SEQ ID NO: 16361 - DNA, 23 bp, Artificial Sequence
  Synthetic
ccgttttttttttttaagtggtc

SEQ ID NO: 16362 - DNA, 23 bp, Artificial Sequence
  Synthetic
ccgttttttttttttggcatagg

SEQ ID NO: 16363 - DNA, 23 bp, Artificial Sequence
  Synthetic
ccgttttttttttttggcatagg

SEQ ID NO: 16364 - DNA, 23 bp, Artificial Sequence
  Synthetic
ccgttttttttttttagactccg

SEQ ID NO: 16365 - DNA, 23 bp, Artificial Sequence
  Synthetic
ccgttttttttttttccaacacc

SEQ ID NO: 16366 - DNA, 23 bp, Artificial Sequence
  Synthetic
ccgttttttttttttgccgctgt

SEQ ID NO: 16367 - DNA, 23 bp, Artificial Sequence
  Synthetic
ccgttttttttttttgccatgac

SEQ ID NO: 16368 - DNA, 23 bp, Artificial Sequence
  Synthetic
ccgttttttttttttgcctgtct

SEQ ID NO: 16369 - DNA, 23 bp, Artificial Sequence
  Synthetic
ccgttttttttttttacagttgc

SEQ ID NO: 16370 - DNA, 23 bp, Artificial Sequence
  Synthetic
ccgttttttttttttacagttgc

SEQ ID NO: 16371 - DNA, 23 bp, Artificial Sequence
  Synthetic
ccgttttttttttttcaatcagt

SEQ ID NO: 16372 - DNA, 23 bp, Artificial Sequence
  Synthetic
ccgttttttttttttacatggtt

SEQ ID NO: 16373 - DNA, 23 bp, Artificial Sequence
  Synthetic
ccgttttttttttttcatggtta

SEQ ID NO: 16374 - DNA, 23 bp, Artificial Sequence
  Synthetic
ccgttttttttttttagaattgc

SEQ ID NO: 16375 - DNA, 23 bp, Artificial Sequence
  Synthetic
ccgttttttttttttaaacccag

SEQ ID NO: 16376 - DNA, 23 bp, Artificial Sequence
  Synthetic
ccgttttttttttttagacccag

SEQ ID NO: 16377 - DNA, 23 bp, Artificial Sequence
  Synthetic
ccgttttttttttttgggtattt

SEQ ID NO: 16378 - DNA, 23 bp, Artificial Sequence
  Synthetic
ccgttttttttttttcagttctt

SEQ ID NO: 16379 - DNA, 23 bp, Artificial Sequence
  Synthetic
ccgttttttttttttcagctctt

SEQ ID NO: 16380 - DNA, 23 bp, Artificial Sequence
  Synthetic
ccgttttttttttttgaaatccc

SEQ ID NO: 16381 - DNA, 23 bp, Artificial Sequence
  Synthetic
ccgttttttttttttgtaatccc

SEQ ID NO: 16382 - DNA, 23 bp, Artificial Sequence
  Synthetic
ccgttttttttttttgttcctgc

SEQ ID NO: 16383 - DNA, 23 bp, Artificial Sequence
  Synthetic
ccgttttttttttttagaccgag

SEQ ID NO: 16384 - DNA, 23 bp, Artificial Sequence
  Synthetic
ccgttttttttttttgcctatcc

SEQ ID NO: 16385 - DNA, 23 bp, Artificial Sequence
  Synthetic
ccgttttttttttttcagaactt

SEQ ID NO: 16386 - DNA, 23 bp, Artificial Sequence
  Synthetic
ccgttttttttttttcagaactt

SEQ ID NO: 16387 - DNA, 23 bp, Artificial Sequence
  Synthetic
ccgttttttttttttactgaact

SEQ ID NO: 16388 - DNA, 23 bp, Artificial Sequence
  Synthetic
ccgttttttttttttaccgattt

SEQ ID NO: 16389 - DNA, 23 bp, Artificial Sequence
  Synthetic
ccgttttttttttttcactgatt

SEQ ID NO: 16390 - DNA, 23 bp, Artificial Sequence
  Synthetic
ccgttttttttttttatgacaat

SEQ ID NO: 16391 - DNA, 23 bp, Artificial Sequence
  Synthetic
ccgttttttttttttgctgagtg

SEQ ID NO: 16392 - DNA, 23 bp, Artificial Sequence
  Synthetic
ccgttttttttttttcgagagtg

SEQ ID NO: 16393 - DNA, 23 bp, Artificial Sequence
  Synthetic
ccgttttttttttttccagtcgg

SEQ ID NO: 16394 - DNA, 23 bp, Artificial Sequence
  Synthetic
ccgttttttttttttaacaaaat

SEQ ID NO: 16395 - DNA, 23 bp, Artificial Sequence
  Synthetic
ccgttttttttttttaaggattt

SEQ ID NO: 16396 - DNA, 23 bp, Artificial Sequence
  Synthetic
ccgttttttttttttacgcgagc

SEQ ID NO: 16397 - DNA, 23 bp, Artificial Sequence
  Synthetic
ccgttttttttttttcggcatta

SEQ ID NO: 16398 - DNA, 23 bp, Artificial Sequence
  Synthetic
ccgttttttttttttgatgtagt

SEQ ID NO: 16399 - DNA, 23 bp, Artificial Sequence
  Synthetic
ccgttttttttttttcagaacca

SEQ ID NO: 16400 - DNA, 23 bp, Artificial Sequence
  Synthetic
ccgttttttttttttatccacat

SEQ ID NO: 16401 - DNA, 23 bp, Artificial Sequence
  Synthetic
ccgttttttttttttcagccgta

SEQ ID NO: 16402 - DNA, 23 bp, Artificial Sequence
  Synthetic
ccgttttttttttttcaacaaaa

SEQ ID NO: 16403 - DNA, 23 bp, Artificial Sequence
  Synthetic
ccgttttttttttttatacagct

SEQ ID NO: 16404 - DNA, 23 bp, Artificial Sequence
  Synthetic
ccgttttttttttttcaggccgg

SEQ ID NO: 16405 - DNA, 23 bp, Artificial Sequence
  Synthetic
ccgttttttttttttgcaaaaat

SEQ ID NO: 16406 - DNA, 23 bp, Artificial Sequence
  Synthetic
ccgttttttttttttcagctggt

SEQ ID NO: 16407 - DNA, 23 bp, Artificial Sequence
  Synthetic
ccgttttttttttttaactgcac

SEQ ID NO: 16408 - DNA, 23 bp, Artificial Sequence
  Synthetic
ccgttttttttttttagttttgc

SEQ ID NO: 16409 - DNA, 23 bp, Artificial Sequence
  Synthetic
ccgttttttttttttacctgcac

SEQ ID NO: 16410 - DNA, 23 bp, Artificial Sequence
  Synthetic
ccgttttttttttttgcccaaaa

SEQ ID NO: 16411 - DNA, 23 bp, Artificial Sequence
  Synthetic
ccgttttttttttttaaccgaac

SEQ ID NO: 16412 - DNA, 23 bp, Artificial Sequence
  Synthetic
ccgttttttttttttggcattac

SEQ ID NO: 16413 - DNA, 23 bp, Artificial Sequence
  Synthetic
ccgttttttttttttactataca

SEQ ID NO: 16414 - DNA, 23 bp, Artificial Sequence
  Synthetic
ccgttttttttttttactacaca

SEQ ID NO: 16415 - DNA, 23 bp, Artificial Sequence
  Synthetic
ccgttttttttttttaccataca

SEQ ID NO: 16416 - DNA, 23 bp, Artificial Sequence
  Synthetic
ccgttttttttttttactaaaca

SEQ ID NO: 16417 - DNA, 23 bp, Artificial Sequence
  Synthetic
ccgttttttttttttctatacaa

SEQ ID NO: 16418 - DNA, 23 bp, Artificial Sequence
  Synthetic
ccgttttttttttttctgtacaa

SEQ ID NO: 16419 - DNA, 23 bp, Artificial Sequence
  Synthetic
ccgttttttttttttcagcacaa

SEQ ID NO: 16420 - DNA, 23 bp, Artificial Sequence
  Synthetic
ccgttttttttttttacaagttc

SEQ ID NO: 16421 - DNA, 23 bp, Artificial Sequence
  Synthetic
ccgttttttttttttcagttatc

SEQ ID NO: 16422 - DNA, 23 bp, Artificial Sequence
  Synthetic
ccgttttttttttttatagccct

SEQ ID NO: 16423 - DNA, 23 bp, Artificial Sequence
  Synthetic
ccgttttttttttttacctgcac

SEQ ID NO: 16424 - DNA, 23 bp, Artificial Sequence
  Synthetic
ccgttttttttttttatagccct

SEQ ID NO: 16425 - DNA, 23 bp, Artificial Sequence
  Synthetic
ccgttttttttttttacaaattc

SEQ ID NO: 16426 - DNA, 23 bp, Artificial Sequence
  Synthetic
ccgttttttttttttcaaattcg

SEQ ID NO: 16427 - DNA, 23 bp, Artificial Sequence
  Synthetic
ccgttttttttttttcaaattcg

SEQ ID NO: 16428 - DNA, 23 bp, Artificial Sequence
  Synthetic
ccgttttttttttttcaaacacc

SEQ ID NO: 16429 - DNA, 23 bp, Artificial Sequence
  Synthetic
ccgttttttttttttgcattcac

SEQ ID NO: 16430 - DNA, 23 bp, Artificial Sequence
  Synthetic
ccgttttttttttttacaggtta

SEQ ID NO: 16431 - DNA, 23 bp, Artificial Sequence
  Synthetic
ccgttttttttttttacaagtta

SEQ ID NO: 16432 - DNA, 23 bp, Artificial Sequence
  Synthetic
ccgttttttttttttcattatta

SEQ ID NO: 16433 - DNA, 23 bp, Artificial Sequence
  Synthetic
ccgttttttttttttgcgtacca

SEQ ID NO: 16434 - DNA, 23 bp, Artificial Sequence
  Synthetic
ccgttttttttttttaaagagac

SEQ ID NO: 16435 - DNA, 23 bp, Artificial Sequence
  Synthetic
ccgttttttttttttcaagccca

SEQ ID NO: 16436 - DNA, 23 bp, Artificial Sequence
  Synthetic
ccgttttttttttttgccctttt

SEQ ID NO: 16437 - DNA, 23 bp, Artificial Sequence
  Synthetic
ccgttttttttttttgccctttc

SEQ ID NO: 16438 - DNA, 23 bp, Artificial Sequence
  Synthetic
ccgttttttttttttgccctttt

SEQ ID NO: 16439 - DNA, 23 bp, Artificial Sequence
  Synthetic
ccgttttttttttttgaccatgg

SEQ ID NO: 16440 - DNA, 23 bp, Artificial Sequence
  Synthetic
ccgttttttttttttcagctggt

SEQ ID NO: 16441 - DNA, 23 bp, Artificial Sequence
  Synthetic
ccgttttttttttttgctggttg

SEQ ID NO: 16442 - DNA, 23 bp, Artificial Sequence
  Synthetic
ccgttttttttttttcagctggt

SEQ ID NO: 16443 - DNA, 23 bp, Artificial Sequence
  Synthetic
ccgttttttttttttcggctggt

SEQ ID NO: 16444 - DNA, 23 bp, Artificial Sequence
  Synthetic
ccgttttttttttttacatagga

SEQ ID NO: 16445 - DNA, 23 bp, Artificial Sequence
  Synthetic
ccgttttttttttttacgcgtat

SEQ ID NO: 16446 - DNA, 23 bp, Artificial Sequence
  Synthetic
ccgttttttttttttattcacaa

SEQ ID NO: 16447 - DNA, 23 bp, Artificial Sequence
  Synthetic
ccgttttttttttttgacacatg

SEQ ID NO: 16448 - DNA, 23 bp, Artificial Sequence
  Synthetic
ccgttttttttttttaccatagg

SEQ ID NO: 16449 - DNA, 23 bp, Artificial Sequence
  Synthetic
ccgttttttttttttcataaagt

SEQ ID NO: 16450 - DNA, 23 bp, Artificial Sequence
  Synthetic
ccgttttttttttttagtgcttt

SEQ ID NO: 16451 - DNA, 23 bp, Artificial Sequence
  Synthetic
ccgttttttttttttgagctaca

SEQ ID NO: 16452 - DNA, 23 bp, Artificial Sequence
  Synthetic
ccgttttttttttttgtacatca

SEQ ID NO: 16453 - DNA, 23 bp, Artificial Sequence
  Synthetic
ccgttttttttttttagggattc

SEQ ID NO: 16454 - DNA, 23 bp, Artificial Sequence
  Synthetic
ccgttttttttttttacctatgg

SEQ ID NO: 16455 - DNA, 23 bp, Artificial Sequence
  Synthetic
ccgttttttttttttcaaagttc

SEQ ID NO: 16456 - DNA, 23 bp, Artificial Sequence
  Synthetic
ccgttttttttttttcaaagttc

SEQ ID NO: 16457 - DNA, 23 bp, Artificial Sequence
  Synthetic
ccgttttttttttttctggtaca

SEQ ID NO: 16458 - DNA, 23 bp, Artificial Sequence
  Synthetic
ccgttttttttttttacttttgt

SEQ ID NO: 16459 - DNA, 23 bp, Artificial Sequence
  Synthetic
ccgttttttttttttccctatca

SEQ ID NO: 16460 - DNA, 23 bp, Artificial Sequence
  Synthetic
ccgttttttttttttacaaacca

SEQ ID NO: 16461 - DNA, 23 bp, Artificial Sequence
  Synthetic
ccgttttttttttttcaaatcat

SEQ ID NO: 16462 - DNA, 23 bp, Artificial Sequence
  Synthetic
ccgttttttttttttcaaaccat

SEQ ID NO: 16463 - DNA, 23 bp, Artificial Sequence
  Synthetic
ccgttttttttttttaccaatat

SEQ ID NO: 16464 - DNA, 23 bp, Artificial Sequence
  Synthetic
ccgttttttttttttcccaatat

SEQ ID NO: 16465 - DNA, 23 bp, Artificial Sequence
  Synthetic
ccgttttttttttttccagtatt

SEQ ID NO: 16466 - DNA, 23 bp, Artificial Sequence
  Synthetic
ccgttttttttttttcaagtgcc

SEQ ID NO: 16467 - DNA, 23 bp, Artificial Sequence
  Synthetic
ccgttttttttttttctacctgc

SEQ ID NO: 16468 - DNA, 23 bp, Artificial Sequence
  Synthetic
ccgttttttttttttctcaccga

SEQ ID NO: 16469 - DNA, 23 bp, Artificial Sequence
  Synthetic
ccgttttttttttttacagtcaa

SEQ ID NO: 16470 - DNA, 23 bp, Artificial Sequence
  Synthetic
ccgttttttttttttccaccgac

SEQ ID NO: 16471 - DNA, 23 bp, Artificial Sequence
  Synthetic
ccgttttttttttttgagttcta

SEQ ID NO: 16472 - DNA, 23 bp, Artificial Sequence
  Synthetic
ccgttttttttttttgttggcaa

SEQ ID NO: 16473 - DNA, 23 bp, Artificial Sequence
  Synthetic
ccgttttttttttttagtgaatt

SEQ ID NO: 16474 - DNA, 23 bp, Artificial Sequence
  Synthetic
ccgttttttttttttgccttatc

SEQ ID NO: 16475 - DNA, 23 bp, Artificial Sequence
  Synthetic
ccgttttttttttttgctgcaac

SEQ ID NO: 16476 - DNA, 23 bp, Artificial Sequence
  Synthetic
ccgttttttttttttctgatatc

SEQ ID NO: 16477 - DNA, 23 bp, Artificial Sequence
  Synthetic
ccgttttttttttttctgcacta

SEQ ID NO: 16478 - DNA, 23 bp, Artificial Sequence
  Synthetic
ccgttttttttttttaactgcac

SEQ ID NO: 16479 - DNA, 23 bp, Artificial Sequence
  Synthetic
ccgttttttttttttgctgcttt

SEQ ID NO: 16480 - DNA, 23 bp, Artificial Sequence
  Synthetic
ccgttttttttttttgctgtcaa

SEQ ID NO: 16481 - DNA, 23 bp, Artificial Sequence
  Synthetic
ccgttttttttttttaagcggga

SEQ ID NO: 16482 - DNA, 23 bp, Artificial Sequence
  Synthetic
ccgttttttttttttcacatgga

SEQ ID NO: 16483 - DNA, 23 bp, Artificial Sequence
  Synthetic
ccgttttttttttttcaacaaca

SEQ ID NO: 16484 - DNA, 23 bp, Artificial Sequence
  Synthetic
ccgttttttttttttcaacaaca

SEQ ID NO: 16485 - DNA, 23 bp, Artificial Sequence
  Synthetic
ccgttttttttttttaacaggta

SEQ ID NO: 16486 - DNA, 23 bp, Artificial Sequence
  Synthetic
ccgttttttttttttaccaatgt

SEQ ID NO: 16487 - DNA, 23 bp, Artificial Sequence
  Synthetic
ccgttttttttttttaacacgta

SEQ ID NO: 16488 - DNA, 23 bp, Artificial Sequence
  Synthetic
ccgttttttttttttagttttgc

SEQ ID NO: 16489 - DNA, 23 bp, Artificial Sequence
  Synthetic
ccgttttttttttttagttttgc

SEQ ID NO: 16490 - DNA, 23 bp, Artificial Sequence
  Synthetic
ccgttttttttttttcatacttc

SEQ ID NO: 16491 - DNA, 23 bp, Artificial Sequence
  Synthetic
ccgttttttttttttcatacttc

SEQ ID NO: 16492 - DNA, 23 bp, Artificial Sequence
  Synthetic
ccgttttttttttttcatcgtta

SEQ ID NO: 16493 - DNA, 23 bp, Artificial Sequence
  Synthetic
ccgttttttttttttcatcatta

SEQ ID NO: 16494 - DNA, 23 bp, Artificial Sequence
  Synthetic
ccgttttttttttttccatgccc

SEQ ID NO: 16495 - DNA, 23 bp, Artificial Sequence
  Synthetic
ccgttttttttttttaagaggta

SEQ ID NO: 16496 - DNA, 23 bp, Artificial Sequence
  Synthetic
ccgttttttttttttaagtggtc

SEQ ID NO: 16497 - DNA, 23 bp, Artificial Sequence
  Synthetic
ccgttttttttttttggcatagg

SEQ ID NO: 16498 - DNA, 23 bp, Artificial Sequence
  Synthetic
ccgttttttttttttagactccg

SEQ ID NO: 16499 - DNA, 23 bp, Artificial Sequence
  Synthetic
ccgttttttttttttaggatccg

SEQ ID NO: 16500 - DNA, 23 bp, Artificial Sequence
  Synthetic
ccgttttttttttttcacacact

SEQ ID NO: 16501 - DNA, 23 bp, Artificial Sequence
  Synthetic
ccgttttttttttttcaagcttt

SEQ ID NO: 16502 - DNA, 23 bp, Artificial Sequence
  Synthetic
ccgttttttttttttacctgcac

SEQ ID NO: 16503 - DNA, 23 bp, Artificial Sequence
  Synthetic
ccgttttttttttttagtgctca

SEQ ID NO: 16504 - DNA, 23 bp, Artificial Sequence
  Synthetic
ccgttttttttttttacctgcac

SEQ ID NO: 16505 - DNA, 23 bp, Artificial Sequence
  Synthetic
ccgttttttttttttgccgctgt

SEQ ID NO: 16506 - DNA, 23 bp, Artificial Sequence
  Synthetic
ccgttttttttttttgccatgac

SEQ ID NO: 16507 - DNA, 23 bp, Artificial Sequence
  Synthetic
ccgttttttttttttgcctgtct

SEQ ID NO: 16508 - DNA, 23 bp, Artificial Sequence
  Synthetic
ccgttttttttttttgctgtcat

SEQ ID NO: 16509 - DNA, 23 bp, Artificial Sequence
  Synthetic
ccgttttttttttttacagttgc

SEQ ID NO: 16510 - DNA, 23 bp, Artificial Sequence
  Synthetic
ccgttttttttttttccaatcag

SEQ ID NO: 16511 - DNA, 23 bp, Artificial Sequence
  Synthetic
ccgttttttttttttcatggtta

SEQ ID NO: 16512 - DNA, 23 bp, Artificial Sequence
  Synthetic
ccgttttttttttttgaattgcg

SEQ ID NO: 16513 - DNA, 23 bp, Artificial Sequence
  Synthetic
ccgttttttttttttcagttctt

SEQ ID NO: 16514 - DNA, 23 bp, Artificial Sequence
  Synthetic
ccgttttttttttttaagcttgc

SEQ ID NO: 16515 - DNA, 23 bp, Artificial Sequence
  Synthetic
ccgttttttttttttaaacccag

SEQ ID NO: 16516 - DNA, 23 bp, Artificial Sequence
  Synthetic
ccgttttttttttttagacccag

SEQ ID NO: 16517 - DNA, 23 bp, Artificial Sequence
  Synthetic
ccgttttttttttttgggtattt

SEQ ID NO: 16518 - DNA, 23 bp, Artificial Sequence
  Synthetic
ccgttttttttttttgaaatccc

SEQ ID NO: 16519 - DNA, 23 bp, Artificial Sequence
  Synthetic
ccgttttttttttttgtaatccc

SEQ ID NO: 16520 - DNA, 23 bp, Artificial Sequence
  Synthetic
ccgttttttttttttgttcctgc

SEQ ID NO: 16521 - DNA, 23 bp, Artificial Sequence
  Synthetic
ccgttttttttttttgtcctgct

SEQ ID NO: 16522 - DNA, 23 bp, Artificial Sequence
  Synthetic
ccgttttttttttttagaccgag

SEQ ID NO: 16523 - DNA, 23 bp, Artificial Sequence
  Synthetic
ccgttttttttttttcctatcct

SEQ ID NO: 16524 - DNA, 23 bp, Artificial Sequence
  Synthetic
ccgttttttttttttcggaactt

SEQ ID NO: 16525 - DNA, 23 bp, Artificial Sequence
  Synthetic
ccgttttttttttttcagaactt

SEQ ID NO: 16526 - DNA, 23 bp, Artificial Sequence
  Synthetic
ccgttttttttttttggaactta

SEQ ID NO: 16527 - DNA, 23 bp, Artificial Sequence
  Synthetic
ccgttttttttttttaccgattt

SEQ ID NO: 16528 - DNA, 23 bp, Artificial Sequence
  Synthetic
ccgttttttttttttacactgat

SEQ ID NO: 16529 - DNA, 23 bp, Artificial Sequence
  Synthetic
ccgttttttttttttccgatttc

SEQ ID NO: 16530 - DNA, 23 bp, Artificial Sequence
  Synthetic
ccgttttttttttttaacaccaa

SEQ ID NO: 16531 - DNA, 23 bp, Artificial Sequence
  Synthetic
ccgttttttttttttacactgat

SEQ ID NO: 16532 - DNA, 23 bp, Artificial Sequence
  Synthetic
ccgttttttttttttctttgaca

SEQ ID NO: 16533 - DNA, 23 bp, Artificial Sequence
  Synthetic
ccgttttttttttttcactaaaa

SEQ ID NO: 16534 - DNA, 23 bp, Artificial Sequence
  Synthetic
ccgttttttttttttctgcaaac

SEQ ID NO: 16535 - DNA, 23 bp, Artificial Sequence
  Synthetic
ccgttttttttttttccagtcga

SEQ ID NO: 16536 - DNA, 23 bp, Artificial Sequence
  Synthetic
ccgttttttttttttgctgagtg

SEQ ID NO: 16537 - DNA, 23 bp, Artificial Sequence
  Synthetic
ccgttttttttttttctgagagt

SEQ ID NO: 16538 - DNA, 23 bp, Artificial Sequence
  Synthetic
ccgttttttttttttccagtcgg

SEQ ID NO: 16539 - DNA, 23 bp, Artificial Sequence
  Synthetic
ccgttttttttttttcagtcaag

SEQ ID NO: 16540 - DNA, 23 bp, Artificial Sequence
  Synthetic
ccgttttttttttttagctatgc

SEQ ID NO: 16541 - DNA, 23 bp, Artificial Sequence
  Synthetic
ccgttttttttttttaacaaaat

SEQ ID NO: 16542 - DNA, 23 bp, Artificial Sequence
  Synthetic
ccgttttttttttttaatgcaac

SEQ ID NO: 16543 - DNA, 23 bp, Artificial Sequence
  Synthetic
ccgttttttttttttaatgcaac

SEQ ID NO: 16544 - DNA, 23 bp, Artificial Sequence
  Synthetic
ccgttttttttttttacaaccag

SEQ ID NO: 16545 - DNA, 23 bp, Artificial Sequence
  Synthetic
ccgttttttttttttaatcagct

SEQ ID NO: 16546 - DNA, 23 bp, Artificial Sequence
  Synthetic
ccgttttttttttttcagatgga

SEQ ID NO: 16547 - DNA, 23 bp, Artificial Sequence
  Synthetic
ccgttttttttttttaattgcat

SEQ ID NO: 16548 - DNA, 23 bp, Artificial Sequence
  Synthetic
ccgttttttttttttaaggattt

SEQ ID NO: 16549 - DNA, 23 bp, Artificial Sequence
  Synthetic
ccgttttttttttttaccattgc

SEQ ID NO: 16550 - DNA, 23 bp, Artificial Sequence
  Synthetic
ccgttttttttttttgccacaat

SEQ ID NO: 16551 - DNA, 23 bp, Artificial Sequence
  Synthetic
ccgttttttttttttaacgggag

SEQ ID NO: 16552 - DNA, 23 bp, Artificial Sequence
  Synthetic
ccgttttttttttttaaccgaac

SEQ ID NO: 16553 - DNA, 23 bp, Artificial Sequence
  Synthetic
ccgttttttttttttcggcatta

SEQ ID NO: 16554 - DNA, 23 bp, Artificial Sequence
  Synthetic
ccgttttttttttttccagctaa

SEQ ID NO: 16555 - DNA, 23 bp, Artificial Sequence
  Synthetic
ccgttttttttttttactcagta

SEQ ID NO: 16556 - DNA, 23 bp, Artificial Sequence
  Synthetic
ccgttttttttttttgatgtagt

SEQ ID NO: 16557 - DNA, 23 bp, Artificial Sequence
  Synthetic
ccgttttttttttttcagccgta

SEQ ID NO: 16558 - DNA, 23 bp, Artificial Sequence
  Synthetic
ccgttttttttttttaaacatca

SEQ ID NO: 16559 - DNA, 23 bp, Artificial Sequence
  Synthetic
ccgttttttttttttaacaaaat

SEQ ID NO: 16560 - DNA, 23 bp, Artificial Sequence
  Synthetic
ccgttttttttttttatacagct

SEQ ID NO: 16561 - DNA, 23 bp, Artificial Sequence
  Synthetic
ccgttttttttttttctttcggt

SEQ ID NO: 16562 - DNA, 23 bp, Artificial Sequence
  Synthetic
ccgttttttttttttaggccggg

SEQ ID NO: 16563 - DNA, 23 bp, Artificial Sequence
  Synthetic
ccgttttttttttttaggccggg

SEQ ID NO: 16564 - DNA, 23 bp, Artificial Sequence
  Synthetic
ccgttttttttttttacctgcac

SEQ ID NO: 16565 - DNA, 23 bp, Artificial Sequence
  Synthetic
ccgttttttttttttacctgcac

SEQ ID NO: 16566 - DNA, 23 bp, Artificial Sequence
  Synthetic
ccgttttttttttttgcaaaaat

SEQ ID NO: 16567 - DNA, 23 bp, Artificial Sequence
  Synthetic
ccgttttttttttttacaataca

SEQ ID NO: 16568 - DNA, 23 bp, Artificial Sequence
  Synthetic
ccgttttttttttttacaagatc

SEQ ID NO: 16569 - DNA, 23 bp, Artificial Sequence
  Synthetic
ccgttttttttttttatacagct

SEQ ID NO: 16570 - DNA, 23 bp, Artificial Sequence
  Synthetic
ccgttttttttttttctttcggt

SEQ ID NO: 16571 - DNA, 23 bp, Artificial Sequence
  Synthetic
ccgttttttttttttatacagct

SEQ ID NO: 16572 - DNA, 23 bp, Artificial Sequence
  Synthetic
ccgttttttttttttcgttcggt

SEQ ID NO: 16573 - DNA, 23 bp, Artificial Sequence
  Synthetic
ccgttttttttttttgctcactc

SEQ ID NO: 16574 - DNA, 23 bp, Artificial Sequence
  Synthetic
ccgttttttttttttgctcactc

SEQ ID NO: 16575 - DNA, 23 bp, Artificial Sequence
  Synthetic
ccgttttttttttttgctcactc

SEQ ID NO: 16576 - DNA, 23 bp, Artificial Sequence
  Synthetic
ccgttttttttttttgctcactc

SEQ ID NO: 16577 - DNA, 23 bp, Artificial Sequence
  Synthetic
ccgttttttttttttgctcactc

SEQ ID NO: 16578 - DNA, 23 bp, Artificial Sequence
  Synthetic
ccgttttttttttttgctcactc

SEQ ID NO: 16579 - DNA, 23 bp, Artificial Sequence
  Synthetic
ccgttttttttttttgctcactc

SEQ ID NO: 16580 - DNA, 23 bp, Artificial Sequence
  Synthetic
ccgttttttttttttgctcactc

SEQ ID NO: 16581 - DNA, 23 bp, Artificial Sequence
  Synthetic
ccgttttttttttttgctcactc

SEQ ID NO: 16582 - DNA, 23 bp, Artificial Sequence
  Synthetic
ccgttttttttttttgctctctc

SEQ ID NO: 16583 - DNA, 23 bp, Artificial Sequence
  Synthetic
ccgttttttttttttgctcgctc

SEQ ID NO: 16584 - DNA, 23 bp, Artificial Sequence
  Synthetic
ccgttttttttttttagagctcc

SEQ ID NO: 16585 - DNA, 23 bp, Artificial Sequence
  Synthetic
ccgttttttttttttagagctcc

SEQ ID NO: 16586 - DNA, 23 bp, Artificial Sequence
  Synthetic
ccgttttttttttttggagctcc

SEQ ID NO: 16587 - DNA, 23 bp, Artificial Sequence
  Synthetic
ccgttttttttttttggagctcc

SEQ ID NO: 16588 - DNA, 23 bp, Artificial Sequence
  Synthetic
ccgttttttttttttgcatacag

SEQ ID NO: 16589 - DNA, 23 bp, Artificial Sequence
  Synthetic
ccgttttttttttttgcatacag

SEQ ID NO: 16590 - DNA, 23 bp, Artificial Sequence
  Synthetic
ccgttttttttttttgcatacag

SEQ ID NO: 16591 - DNA, 23 bp, Artificial Sequence
  Synthetic
ccgttttttttttttgcatacag

SEQ ID NO: 16592 - DNA, 23 bp, Artificial Sequence
  Synthetic
ccgttttttttttttgcatacag

SEQ ID NO: 16593 - DNA, 23 bp, Artificial Sequence
  Synthetic
ccgttttttttttttggcataca

SEQ ID NO: 16594 - DNA, 23 bp, Artificial Sequence
  Synthetic
ccgttttttttttttgatgcaga

SEQ ID NO: 16595 - DNA, 23 bp, Artificial Sequence
  Synthetic
ccgttttttttttttcacgtgcc

SEQ ID NO: 16596 - DNA, 23 bp, Artificial Sequence
  Synthetic
ccgttttttttttttcacgtgcc

SEQ ID NO: 16597 - DNA, 23 bp, Artificial Sequence
  Synthetic
ccgttttttttttttcacgtgcc

SEQ ID NO: 16598 - DNA, 23 bp, Artificial Sequence
  Synthetic
ccgttttttttttttcacgtgcc

SEQ ID NO: 16599 - DNA, 23 bp, Artificial Sequence
  Synthetic
ccgttttttttttttgggaatga

SEQ ID NO: 16600 - DNA, 23 bp, Artificial Sequence
  Synthetic
ccgttttttttttttggaatgaa

SEQ ID NO: 16601 - DNA, 23 bp, Artificial Sequence
  Synthetic
ccgttttttttttttggaatgaa

SEQ ID NO: 16602 - DNA, 23 bp, Artificial Sequence
  Synthetic
ccgttttttttttttggaatgaa

SEQ ID NO: 16603 - DNA, 23 bp, Artificial Sequence
  Synthetic
ccgttttttttttttggaatgaa

SEQ ID NO: 16604 - DNA, 23 bp, Artificial Sequence
  Synthetic
ccgttttttttttttggaatgaa

SEQ ID NO: 16605 - DNA, 23 bp, Artificial Sequence
  Synthetic
ccgttttttttttttggaatgaa

SEQ ID NO: 16606 - DNA, 23 bp, Artificial Sequence
  Synthetic
ccgttttttttttttggaatgaa

SEQ ID NO: 16607 - DNA, 23 bp, Artificial Sequence
  Synthetic
ccgttttttttttttggaatgaa

SEQ ID NO: 16608 - DNA, 23 bp, Artificial Sequence
  Synthetic
ccgttttttttttttgggattga

SEQ ID NO: 16609 - DNA, 23 bp, Artificial Sequence
  Synthetic
ccgttttttttttttgggattga

SEQ ID NO: 16610 - DNA, 23 bp, Artificial Sequence
  Synthetic
ccgttttttttttttaggaatga

SEQ ID NO: 16611 - DNA, 23 bp, Artificial Sequence
  Synthetic
ccgttttttttttttaggaatga

SEQ ID NO: 16612 - DNA, 23 bp, Artificial Sequence
  Synthetic
ccgttttttttttttgatcatgc

SEQ ID NO: 16613 - DNA, 23 bp, Artificial Sequence
  Synthetic
ccgttttttttttttgatcatgc

SEQ ID NO: 16614 - DNA, 23 bp, Artificial Sequence
  Synthetic
ccgttttttttttttgatcatgc

SEQ ID NO: 16615 - DNA, 23 bp, Artificial Sequence
  Synthetic
ccgttttttttttttgatcatgc

SEQ ID NO: 16616 - DNA, 23 bp, Artificial Sequence
  Synthetic
ccgttttttttttttagatcatg

SEQ ID NO: 16617 - DNA, 23 bp, Artificial Sequence
  Synthetic
ccgttttttttttttagatcatg

SEQ ID NO: 16618 - DNA, 23 bp, Artificial Sequence
  Synthetic
ccgttttttttttttagatcatg

SEQ ID NO: 16619 - DNA, 23 bp, Artificial Sequence
  Synthetic
ccgttttttttttttagatcatg

SEQ ID NO: 16620 - DNA, 23 bp, Artificial Sequence
  Synthetic
ccgttttttttttttagatcatg

SEQ ID NO: 16621 - DNA, 23 bp, Artificial Sequence
  Synthetic
ccgttttttttttttcccgatct

SEQ ID NO: 16622 - DNA, 23 bp, Artificial Sequence
  Synthetic
ccgttttttttttttcccgatct

SEQ ID NO: 16623 - DNA, 23 bp, Artificial Sequence
  Synthetic
ccgttttttttttttggcaagtc

SEQ ID NO: 16624 - DNA, 23 bp, Artificial Sequence
  Synthetic
ccgttttttttttttggcaagtc

SEQ ID NO: 16625 - DNA, 23 bp, Artificial Sequence
  Synthetic
ccgttttttttttttcggcaagt

SEQ ID NO: 16626 - DNA, 23 bp, Artificial Sequence
  Synthetic
ccgttttttttttttataggcag

SEQ ID NO: 16627 - DNA, 23 bp, Artificial Sequence
  Synthetic
ccgttttttttttttgtaggcag

SEQ ID NO: 16628 - DNA, 23 bp, Artificial Sequence
  Synthetic
ccgttttttttttttggcaagtc

SEQ ID NO: 16629 - DNA, 23 bp, Artificial Sequence
  Synthetic
ccgttttttttttttggcaagtc

SEQ ID NO: 16630 - DNA, 23 bp, Artificial Sequence
  Synthetic
ccgttttttttttttggcaagtc

SEQ ID NO: 16631 - DNA, 23 bp, Artificial Sequence
  Synthetic
ccgttttttttttttaggcaagt

SEQ ID NO: 16632 - DNA, 23 bp, Artificial Sequence
  Synthetic
ccgttttttttttttaggcaagt

SEQ ID NO: 16633 - DNA, 23 bp, Artificial Sequence
  Synthetic
ccgttttttttttttaggcaagt

SEQ ID NO: 16634 - DNA, 23 bp, Artificial Sequence
  Synthetic
ccgttttttttttttattggcgc

SEQ ID NO: 16635 - DNA, 23 bp, Artificial Sequence
  Synthetic
ccgttttttttttttgatattgg

SEQ ID NO: 16636 - DNA, 23 bp, Artificial Sequence
  Synthetic
ccgttttttttttttatattggc

SEQ ID NO: 16637 - DNA, 23 bp, Artificial Sequence
  Synthetic
ccgttttttttttttatattggc

SEQ ID NO: 16638 - DNA, 23 bp, Artificial Sequence
  Synthetic
ccgttttttttttttatattggc

SEQ ID NO: 16639 - DNA, 23 bp, Artificial Sequence
  Synthetic
ccgttttttttttttgatattgg

SEQ ID NO: 16640 - DNA, 23 bp, Artificial Sequence
  Synthetic
ccgttttttttttttatattggc

SEQ ID NO: 16641 - DNA, 23 bp, Artificial Sequence
  Synthetic
ccgttttttttttttgtgatatt

SEQ ID NO: 16642 - DNA, 23 bp, Artificial Sequence
  Synthetic
ccgttttttttttttatattggc

SEQ ID NO: 16643 - DNA, 23 bp, Artificial Sequence
  Synthetic
ccgttttttttttttatattggc

SEQ ID NO: 16644 - DNA, 23 bp, Artificial Sequence
  Synthetic
ccgttttttttttttgtgatatt

SEQ ID NO: 16645 - DNA, 23 bp, Artificial Sequence
  Synthetic
ccgttttttttttttcagcatca

SEQ ID NO: 16646 - DNA, 23 bp, Artificial Sequence
  Synthetic
ccgttttttttttttcagcatca

SEQ ID NO: 16647 - DNA, 23 bp, Artificial Sequence
  Synthetic
ccgttttttttttttcagcatca

SEQ ID NO: 16648 - DNA, 23 bp, Artificial Sequence
  Synthetic
ccgttttttttttttcagcatca

SEQ ID NO: 16649 - DNA, 23 bp, Artificial Sequence
  Synthetic
ccgttttttttttttgcagcatc

SEQ ID NO: 16650 - DNA, 23 bp, Artificial Sequence
  Synthetic
ccgttttttttttttggagcacc

SEQ ID NO: 16651 - DNA, 23 bp, Artificial Sequence
  Synthetic
ccgttttttttttttggagcacc

SEQ ID NO: 16652 - DNA, 23 bp, Artificial Sequence
  Synthetic
ccgttttttttttttggagcacc

SEQ ID NO: 16653 - DNA, 23 bp, Artificial Sequence
  Synthetic
ccgttttttttttttggagcacc

SEQ ID NO: 16654 - DNA, 23 bp, Artificial Sequence
  Synthetic
ccgttttttttttttgatcaatg

SEQ ID NO: 16655 - DNA, 23 bp, Artificial Sequence
  Synthetic
ccgttttttttttttgaggtgga

SEQ ID NO: 16656 - DNA, 23 bp, Artificial Sequence
  Synthetic
ccgttttttttttttgaggtgga

SEQ ID NO: 16657 - DNA, 23 bp, Artificial Sequence
  Synthetic
ccgttttttttttttagttcccc

SEQ ID NO: 16658 - DNA, 23 bp, Artificial Sequence
  Synthetic
ccgttttttttttttagttcccc

SEQ ID NO: 16659 - DNA, 23 bp, Artificial Sequence
  Synthetic
ccgttttttttttttagttcctc

SEQ ID NO: 16660 - DNA, 23 bp, Artificial Sequence
  Synthetic
ccgttttttttttttagttcaag

SEQ ID NO: 16661 - DNA, 23 bp, Artificial Sequence
  Synthetic
ccgttttttttttttagttcaag

SEQ ID NO: 16662 - DNA, 23 bp, Artificial Sequence
  Synthetic
ccgttttttttttttagggcaat

SEQ ID NO: 16663 - DNA, 23 bp, Artificial Sequence
  Synthetic
ccgttttttttttttaggacagc

SEQ ID NO: 16664 - DNA, 23 bp, Artificial Sequence
  Synthetic
ccgttttttttttttagggcaat

SEQ ID NO: 16665 - DNA, 23 bp, Artificial Sequence
  Synthetic
ccgttttttttttttagggcagc

SEQ ID NO: 16666 - DNA, 23 bp, Artificial Sequence
  Synthetic
ccgttttttttttttagggcaac

SEQ ID NO: 16667 - DNA, 23 bp, Artificial Sequence
  Synthetic
ccgttttttttttttggggcaaa

SEQ ID NO: 16668 - DNA, 23 bp, Artificial Sequence
  Synthetic
ccgttttttttttttccagggaa

SEQ ID NO: 16669 - DNA, 23 bp, Artificial Sequence
  Synthetic
ccgttttttttttttcagctttc

SEQ ID NO: 16670 - DNA, 23 bp, Artificial Sequence
  Synthetic
ccgttttttttttttatacaacc

SEQ ID NO: 16671 - DNA, 23 bp, Artificial Sequence
  Synthetic
ccgttttttttttttcatacttc

SEQ ID NO: 16672 - DNA, 23 bp, Artificial Sequence
  Synthetic
ccgttttttttttttaaattcgg

SEQ ID NO: 16673 - DNA, 23 bp, Artificial Sequence
  Synthetic
ccgttttttttttttcaagttcg

SEQ ID NO: 16674 - DNA, 23 bp, Artificial Sequence
  Synthetic
ccgttttttttttttgcattcac

SEQ ID NO: 16675 - DNA, 23 bp, Artificial Sequence
  Synthetic
ccgttttttttttttcaagttag

SEQ ID NO: 16676 - DNA, 23 bp, Artificial Sequence
  Synthetic
ccgttttttttttttagctggtt

SEQ ID NO: 16677 - DNA, 23 bp, Artificial Sequence
  Synthetic
ccgttttttttttttcgtcaaaa

SEQ ID NO: 16678 - DNA, 23 bp, Artificial Sequence
  Synthetic
ccgttttttttttttgagagaga

SEQ ID NO: 16679 - DNA, 23 bp, Artificial Sequence
  Synthetic
ccgttttttttttttcttatcag

SEQ ID NO: 16680 - DNA, 23 bp, Artificial Sequence
  Synthetic
ccgttttttttttttacagccag

SEQ ID NO: 16681 - DNA, 23 bp, Artificial Sequence
  Synthetic
ccgttttttttttttccgttgtc

SEQ ID NO: 16682 - DNA, 23 bp, Artificial Sequence
  Synthetic
ccgttttttttttttagaattgc

SEQ ID NO: 16683 - DNA, 23 bp, Artificial Sequence
  Synthetic
ccgttttttttttttaattcttc

SEQ ID NO: 16684 - DNA, 23 bp, Artificial Sequence
  Synthetic
ccgttttttttttttcgcgctac

SEQ ID NO: 16685 - DNA, 23 bp, Artificial Sequence
  Synthetic
ccgttttttttttttaggaactc

SEQ ID NO: 16686 - DNA, 23 bp, Artificial Sequence
  Synthetic
ccgttttttttttttgtaccaga

SEQ ID NO: 16687 - DNA, 23 bp, Artificial Sequence
  Synthetic
ccgttttttttttttacggacga

SEQ ID NO: 16688 - DNA, 23 bp, Artificial Sequence
  Synthetic
ccgttttttttttttgagtgtgg

SEQ ID NO: 16689 - DNA, 23 bp, Artificial Sequence
  Synthetic
ccgttttttttttttaagagagc

SEQ ID NO: 16690 - DNA, 23 bp, Artificial Sequence
  Synthetic
ccgttttttttttttagacaaag

SEQ ID NO: 16691 - DNA, 23 bp, Artificial Sequence
  Synthetic
ccgttttttttttttaattacca

SEQ ID NO: 16692 - DNA, 23 bp, Artificial Sequence
  Synthetic
ccgttttttttttttgagcacct

SEQ ID NO: 16693 - DNA, 23 bp, Artificial Sequence
  Synthetic
ccgttttttttttttactcaagg

SEQ ID NO: 16694 - DNA, 23 bp, Artificial Sequence
  Synthetic
ccgttttttttttttacagtata

SEQ ID NO: 16695 - DNA, 23 bp, Artificial Sequence
  Synthetic
ccgttttttttttttctgagcaa

SEQ ID NO: 16696 - DNA, 23 bp, Artificial Sequence
  Synthetic
ccgttttttttttttgagatacc

SEQ ID NO: 16697 - DNA, 23 bp, Artificial Sequence
  Synthetic
ccgttttttttttttaacaaaat

SEQ ID NO: 16698 - DNA, 23 bp, Artificial Sequence
  Synthetic
ccgttttttttttttctttggta

SEQ ID NO: 16699 - DNA, 23 bp, Artificial Sequence
  Synthetic
ccgttttttttttttcatcttta

SEQ ID NO: 16700 - DNA, 23 bp, Artificial Sequence
  Synthetic
ccgttttttttttttggccggga

SEQ ID NO: 16701 - DNA, 23 bp, Artificial Sequence
  Synthetic
ccgttttttttttttaggccggg

SEQ ID NO: 16702 - DNA, 23 bp, Artificial Sequence
  Synthetic
ccgttttttttttttacagctag

SEQ ID NO: 16703 - DNA, 23 bp, Artificial Sequence
  Synthetic
ccgttttttttttttacagctaa

SEQ ID NO: 16704 - DNA, 23 bp, Artificial Sequence
  Synthetic
ccgttttttttttttcagctaga

SEQ ID NO: 16705 - DNA, 23 bp, Artificial Sequence
  Synthetic
ccgttttttttttttggatacat

SEQ ID NO: 16706 - DNA, 23 bp, Artificial Sequence
  Synthetic
ccgttttttttttttcaagttcg

SEQ ID NO: 16707 - DNA, 23 bp, Artificial Sequence
  Synthetic
ccgttttttttttttagttatca

SEQ ID NO: 16708 - DNA, 23 bp, Artificial Sequence
  Synthetic
ccgttttttttttttagccctgt

SEQ ID NO: 16709 - DNA, 23 bp, Artificial Sequence
  Synthetic
ccgttttttttttttacctgcac

SEQ ID NO: 16710 - DNA, 23 bp, Artificial Sequence
  Synthetic
ccgttttttttttttgcactgtc

SEQ ID NO: 16711 - DNA, 23 bp, Artificial Sequence
  Synthetic
ccgttttttttttttcaaattcg

SEQ ID NO: 16712 - DNA, 23 bp, Artificial Sequence
  Synthetic
ccgttttttttttttcattcacc

SEQ ID NO: 16713 - DNA, 23 bp, Artificial Sequence
  Synthetic
ccgttttttttttttcaagttag

SEQ ID NO: 16714 - DNA, 23 bp, Artificial Sequence
  Synthetic
ccgttttttttttttccaagctc

SEQ ID NO: 16715 - DNA, 23 bp, Artificial Sequence
  Synthetic
ccgttttttttttttaagagacc

SEQ ID NO: 16716 - DNA, 23 bp, Artificial Sequence
  Synthetic
ccgttttttttttttagctggtt

SEQ ID NO: 16717 - DNA, 23 bp, Artificial Sequence
  Synthetic
ccgttttttttttttcataggaa

SEQ ID NO: 16718 - DNA, 23 bp, Artificial Sequence
  Synthetic
ccgttttttttttttcaaaccat

SEQ ID NO: 16719 - DNA, 23 bp, Artificial Sequence
  Synthetic
ccgttttttttttttaaccatga

SEQ ID NO: 16720 - DNA, 23 bp, Artificial Sequence
  Synthetic
ccgttttttttttttccaatatt

SEQ ID NO: 16721 - DNA, 23 bp, Artificial Sequence
  Synthetic
ccgttttttttttttaagtgcct

SEQ ID NO: 16722 - DNA, 23 bp, Artificial Sequence
  Synthetic
ccgttttttttttttacctgcac

SEQ ID NO: 16723 - DNA, 23 bp, Artificial Sequence
  Synthetic
ccgttttttttttttgcactaga

SEQ ID NO: 16724 - DNA, 23 bp, Artificial Sequence
  Synthetic
ccgttttttttttttacatggag

SEQ ID NO: 16725 - DNA, 23 bp, Artificial Sequence
  Synthetic
ccgttttttttttttcaacaaca

SEQ ID NO: 16726 - DNA, 23 bp, Artificial Sequence
  Synthetic
ccgttttttttttttgggtggag

SEQ ID NO: 16727 - DNA, 23 bp, Artificial Sequence
  Synthetic
ccgttttttttttttagctcccc

SEQ ID NO: 16728 - DNA, 23 bp, Artificial Sequence
  Synthetic
ccgttttttttttttgttttgca

SEQ ID NO: 16729 - DNA, 23 bp, Artificial Sequence
  Synthetic
ccgttttttttttttgttttgca

SEQ ID NO: 16730 - DNA, 23 bp, Artificial Sequence
  Synthetic
ccgttttttttttttctgcacta

SEQ ID NO: 16731 - DNA, 23 bp, Artificial Sequence
  Synthetic
ccgttttttttttttgactccgg

SEQ ID NO: 16732 - DNA, 23 bp, Artificial Sequence
  Synthetic
ccgttttttttttttacatcagt

SEQ ID NO: 16733 - DNA, 23 bp, Artificial Sequence
  Synthetic
ccgttttttttttttcctgtctg

SEQ ID NO: 16734 - DNA, 23 bp, Artificial Sequence
  Synthetic
ccgttttttttttttatggttag

SEQ ID NO: 16735 - DNA, 23 bp, Artificial Sequence
  Synthetic
ccgttttttttttttagttcttc

SEQ ID NO: 16736 - DNA, 23 bp, Artificial Sequence
  Synthetic
ccgttttttttttttgacccagt

SEQ ID NO: 16737 - DNA, 23 bp, Artificial Sequence
  Synthetic
ccgttttttttttttaaatccct

SEQ ID NO: 16738 - DNA, 23 bp, Artificial Sequence
  Synthetic
ccgttttttttttttcggaactt

SEQ ID NO: 16739 - DNA, 23 bp, Artificial Sequence
  Synthetic
ccgttttttttttttaatagact

SEQ ID NO: 16740 - DNA, 23 bp, Artificial Sequence
  Synthetic
ccgttttttttttttccgatttc

SEQ ID NO: 16741 - DNA, 23 bp, Artificial Sequence
  Synthetic
ccgttttttttttttgatttcaa

SEQ ID NO: 16742 - DNA, 23 bp, Artificial Sequence
  Synthetic
ccgttttttttttttgagtgtag

SEQ ID NO: 16743 - DNA, 23 bp, Artificial Sequence
  Synthetic
ccgttttttttttttaaccagct

SEQ ID NO: 16744 - DNA, 23 bp, Artificial Sequence
  Synthetic
ccgttttttttttttacagctag

SEQ ID NO: 16745 - DNA, 23 bp, Artificial Sequence
  Synthetic
ccgttttttttttttaggccggg

SEQ ID NO: 16746 - DNA, 23 bp, Artificial Sequence
  Synthetic
ccgttttttttttttcctgcacg

SEQ ID NO: 16747 - DNA, 23 bp, Artificial Sequence
  Synthetic
ccgttttttttttttcaatacaa

SEQ ID NO: 16748 - DNA, 23 bp, Artificial Sequence
  Synthetic
ccgttttttttttttcagctttc

SEQ ID NO: 16749 - DNA, 23 bp, Artificial Sequence
  Synthetic
ccgttttttttttttcatacttc

SEQ ID NO: 16750 - DNA, 23 bp, Artificial Sequence
  Synthetic
ccgttttttttttttcagtacct

SEQ ID NO: 16751 - DNA, 23 bp, Artificial Sequence
  Synthetic
ccgttttttttttttgcattcac

SEQ ID NO: 16752 - DNA, 23 bp, Artificial Sequence
  Synthetic
ccgttttttttttttcaagttag

SEQ ID NO: 16753 - DNA, 23 bp, Artificial Sequence
  Synthetic
ccgttttttttttttagctggtt

SEQ ID NO: 16754 - DNA, 23 bp, Artificial Sequence
  Synthetic
ccgttttttttttttccttatca

SEQ ID NO: 16755 - DNA, 23 bp, Artificial Sequence
  Synthetic
ccgttttttttttttcatcaaag

SEQ ID NO: 16756 - DNA, 23 bp, Artificial Sequence
  Synthetic
ccgttttttttttttccgctgtc

SEQ ID NO: 16757 - DNA, 23 bp, Artificial Sequence
  Synthetic
ccgttttttttttttagaattgc

SEQ ID NO: 16758 - DNA, 23 bp, Artificial Sequence
  Synthetic
ccgttttttttttttaattcttc

SEQ ID NO: 16759 - DNA, 23 bp, Artificial Sequence
  Synthetic
ccgttttttttttttagcacggt

SEQ ID NO: 16760 - DNA, 23 bp, Artificial Sequence
  Synthetic
ccgttttttttttttgtaccaga

SEQ ID NO: 16761 - DNA, 23 bp, Artificial Sequence
  Synthetic
ccgttttttttttttacggacga

SEQ ID NO: 16762 - DNA, 23 bp, Artificial Sequence
  Synthetic
ccgttttttttttttaaagagag

SEQ ID NO: 16763 - DNA, 23 bp, Artificial Sequence
  Synthetic
ccgttttttttttttagacaaag

SEQ ID NO: 16764 - DNA, 23 bp, Artificial Sequence
  Synthetic
ccgttttttttttttgagcacct

SEQ ID NO: 16765 - DNA, 23 bp, Artificial Sequence
  Synthetic
ccgttttttttttttctgagcaa

SEQ ID NO: 16766 - DNA, 23 bp, Artificial Sequence
  Synthetic
ccgttttttttttttgagatacc

SEQ ID NO: 16767 - DNA, 23 bp, Artificial Sequence
  Synthetic
ccgttttttttttttaacaaaat

SEQ ID NO: 16768 - DNA, 23 bp, Artificial Sequence
  Synthetic
ccgttttttttttttcatcttta

SEQ ID NO: 16769 - DNA, 23 bp, Artificial Sequence
  Synthetic
ccgttttttttttttacagctag

SEQ ID NO: 16770 - DNA, 23 bp, Artificial Sequence
  Synthetic
ccgttttttttttttaaagctag

SEQ ID NO: 16771 - DNA, 23 bp, Artificial Sequence
  Synthetic
ccgttttttttttttggatacat

SEQ ID NO: 16772 - DNA, 23 bp, Artificial Sequence
  Synthetic
ccgttttttttttttctcactct

SEQ ID NO: 16773 - DNA, 23 bp, Artificial Sequence
  Synthetic
ccgttttttttttttctcactct

SEQ ID NO: 16774 - DNA, 23 bp, Artificial Sequence
  Synthetic
ccgttttttttttttctcactct

SEQ ID NO: 16775 - DNA, 23 bp, Artificial Sequence
  Synthetic
ccgttttttttttttctcactct

SEQ ID NO: 16776 - DNA, 23 bp, Artificial Sequence
  Synthetic
ccgttttttttttttctcactct

SEQ ID NO: 16777 - DNA, 23 bp, Artificial Sequence
  Synthetic
ccgttttttttttttctcactct

SEQ ID NO: 16778 - DNA, 23 bp, Artificial Sequence
  Synthetic
ccgttttttttttttctcactct

SEQ ID NO: 16779 - DNA, 23 bp, Artificial Sequence
  Synthetic
ccgttttttttttttctctcttt

SEQ ID NO: 16780 - DNA, 23 bp, Artificial Sequence
  Synthetic
ccgttttttttttttctctctat

SEQ ID NO: 16781 - DNA, 23 bp, Artificial Sequence
  Synthetic
ccgttttttttttttctctctat

SEQ ID NO: 16782 - DNA, 23 bp, Artificial Sequence
  Synthetic
ccgttttttttttttctctctat

SEQ ID NO: 16783 - DNA, 23 bp, Artificial Sequence
  Synthetic
ccgttttttttttttctctctat

SEQ ID NO: 16784 - DNA, 23 bp, Artificial Sequence
  Synthetic
ccgttttttttttttgtctacat

SEQ ID NO: 16785 - DNA, 23 bp, Artificial Sequence
  Synthetic
ccgttttttttttttgtctacat

SEQ ID NO: 16786 - DNA, 23 bp, Artificial Sequence
  Synthetic
ccgttttttttttttagctccct

SEQ ID NO: 16787 - DNA, 23 bp, Artificial Sequence
  Synthetic
ccgttttttttttttgagctccc

SEQ ID NO: 16788 - DNA, 23 bp, Artificial Sequence
  Synthetic
ccgttttttttttttgagctccc

SEQ ID NO: 16789 - DNA, 23 bp, Artificial Sequence
  Synthetic
ccgttttttttttttcatacagg

SEQ ID NO: 16790 - DNA, 23 bp, Artificial Sequence
  Synthetic
ccgttttttttttttcatacagg

SEQ ID NO: 16791 - DNA, 23 bp, Artificial Sequence
  Synthetic
ccgttttttttttttcatacagg

SEQ ID NO: 16792 - DNA, 23 bp, Artificial Sequence
  Synthetic
ccgttttttttttttccgatgta

SEQ ID NO: 16793 - DNA, 23 bp, Artificial Sequence
  Synthetic
ccgttttttttttttgatgcaga

SEQ ID NO: 16794 - DNA, 23 bp, Artificial Sequence
  Synthetic
ccgttttttttttttgatgcaga

SEQ ID NO: 16795 - DNA, 23 bp, Artificial Sequence
  Synthetic
ccgttttttttttttgaagttcc

SEQ ID NO: 16796 - DNA, 23 bp, Artificial Sequence
  Synthetic
ccgttttttttttttacgtgccc

SEQ ID NO: 16797 - DNA, 23 bp, Artificial Sequence
  Synthetic
ccgttttttttttttacgtgccc

SEQ ID NO: 16798 - DNA, 23 bp, Artificial Sequence
  Synthetic
ccgttttttttttttcacgtgcc

SEQ ID NO: 16799 - DNA, 23 bp, Artificial Sequence
  Synthetic
ccgttttttttttttgggatgaa

SEQ ID NO: 16800 - DNA, 23 bp, Artificial Sequence
  Synthetic
ccgttttttttttttgggatgaa

SEQ ID NO: 16801 - DNA, 23 bp, Artificial Sequence
  Synthetic
ccgttttttttttttggaatgaa

SEQ ID NO: 16802 - DNA, 23 bp, Artificial Sequence
  Synthetic
ccgttttttttttttggaatgaa

SEQ ID NO: 16803 - DNA, 23 bp, Artificial Sequence
  Synthetic
ccgttttttttttttggaatgaa

SEQ ID NO: 16804 - DNA, 23 bp, Artificial Sequence
  Synthetic
ccgttttttttttttggaatgaa

SEQ ID NO: 16805 - DNA, 23 bp, Artificial Sequence
  Synthetic
ccgttttttttttttggaatgaa

SEQ ID NO: 16806 - DNA, 23 bp, Artificial Sequence
  Synthetic
ccgttttttttttttggaatgaa

SEQ ID NO: 16807 - DNA, 23 bp, Artificial Sequence
  Synthetic
ccgttttttttttttggaatgaa

SEQ ID NO: 16808 - DNA, 23 bp, Artificial Sequence
  Synthetic
ccgttttttttttttatcatgct

SEQ ID NO: 16809 - DNA, 23 bp, Artificial Sequence
  Synthetic
ccgttttttttttttatcatgct

SEQ ID NO: 16810 - DNA, 23 bp, Artificial Sequence
  Synthetic
ccgttttttttttttgatcatgc

SEQ ID NO: 16811 - DNA, 23 bp, Artificial Sequence
  Synthetic
ccgttttttttttttagatcatg

SEQ ID NO: 16812 - DNA, 23 bp, Artificial Sequence
  Synthetic
ccgttttttttttttcgacctgc

SEQ ID NO: 16813 - DNA, 23 bp, Artificial Sequence
  Synthetic
ccgttttttttttttcgacctgc

SEQ ID NO: 16814 - DNA, 23 bp, Artificial Sequence
  Synthetic
ccgttttttttttttgcaagtca

SEQ ID NO: 16815 - DNA, 23 bp, Artificial Sequence
  Synthetic
ccgttttttttttttggcaagtc

SEQ ID NO: 16816 - DNA, 23 bp, Artificial Sequence
  Synthetic
ccgttttttttttttggcaagtc

SEQ ID NO: 16817 - DNA, 23 bp, Artificial Sequence
  Synthetic
ccgttttttttttttgcaagtca

SEQ ID NO: 16818 - DNA, 23 bp, Artificial Sequence
  Synthetic
ccgttttttttttttgcaagtca

SEQ ID NO: 16819 - DNA, 23 bp, Artificial Sequence
  Synthetic
ccgttttttttttttgcaagtca

SEQ ID NO: 16820 - DNA, 23 bp, Artificial Sequence
  Synthetic
ccgttttttttttttgcaagtca

SEQ ID NO: 16821 - DNA, 23 bp, Artificial Sequence
  Synthetic
ccgttttttttttttccaaggtc

SEQ ID NO: 16822 - DNA, 23 bp, Artificial Sequence
  Synthetic
ccgttttttttttttggcaagtc

SEQ ID NO: 16823 - DNA, 23 bp, Artificial Sequence
  Synthetic
ccgttttttttttttggcaagtc

SEQ ID NO: 16824 - DNA, 23 bp, Artificial Sequence
  Synthetic
ccgttttttttttttggcaagtc

SEQ ID NO: 16825 - DNA, 23 bp, Artificial Sequence
  Synthetic
ccgttttttttttttggcaagtc

SEQ ID NO: 16826 - DNA, 23 bp, Artificial Sequence
  Synthetic
ccgttttttttttttggcaagtc

SEQ ID NO: 16827 - DNA, 23 bp, Artificial Sequence
  Synthetic
ccgttttttttttttggcaagtc

SEQ ID NO: 16828 - DNA, 23 bp, Artificial Sequence
  Synthetic
ccgttttttttttttggcaagtc

SEQ ID NO: 16829 - DNA, 23 bp, Artificial Sequence
  Synthetic
ccgttttttttttttattgacac

SEQ ID NO: 16830 - DNA, 23 bp, Artificial Sequence
  Synthetic
ccgttttttttttttattggcgc

SEQ ID NO: 16831 - DNA, 23 bp, Artificial Sequence
  Synthetic
ccgttttttttttttgatattgg

SEQ ID NO: 16832 - DNA, 23 bp, Artificial Sequence
  Synthetic
ccgttttttttttttgatattgg

SEQ ID NO: 16833 - DNA, 23 bp, Artificial Sequence
  Synthetic
ccgttttttttttttcagcatca

SEQ ID NO: 16834 - DNA, 23 bp, Artificial Sequence
  Synthetic
ccgttttttttttttcagcatca

SEQ ID NO: 16835 - DNA, 23 bp, Artificial Sequence
  Synthetic
ccgttttttttttttaatcttaa

SEQ ID NO: 16836 - DNA, 23 bp, Artificial Sequence
  Synthetic
ccgttttttttttttcagcatca

SEQ ID NO: 16837 - DNA, 23 bp, Artificial Sequence
  Synthetic
ccgttttttttttttcagcatca

SEQ ID NO: 16838 - DNA, 23 bp, Artificial Sequence
  Synthetic
ccgttttttttttttcagcatca

SEQ ID NO: 16839 - DNA, 23 bp, Artificial Sequence
  Synthetic
ccgttttttttttttatttctct

SEQ ID NO: 16840 - DNA, 23 bp, Artificial Sequence
  Synthetic
ccgttttttttttttgagctccc

SEQ ID NO: 16841 - DNA, 23 bp, Artificial Sequence
  Synthetic
ccgttttttttttttgagctccc

SEQ ID NO: 16842 - DNA, 23 bp, Artificial Sequence
  Synthetic
ccgttttttttttttgagctccc

SEQ ID NO: 16843 - DNA, 23 bp, Artificial Sequence
  Synthetic
ccgttttttttttttcgctatcc

SEQ ID NO: 16844 - DNA, 23 bp, Artificial Sequence
  Synthetic
ccgttttttttttttcgctatcc

SEQ ID NO: 16845 - DNA, 23 bp, Artificial Sequence
  Synthetic
ccgttttttttttttcgctatct

SEQ ID NO: 16846 - DNA, 23 bp, Artificial Sequence
  Synthetic
ccgttttttttttttcaatgcga

SEQ ID NO: 16847 - DNA, 23 bp, Artificial Sequence
  Synthetic
ccgttttttttttttcaatgcga

SEQ ID NO: 16848 - DNA, 23 bp, Artificial Sequence
  Synthetic
ccgttttttttttttaggtggac

SEQ ID NO: 16849 - DNA, 23 bp, Artificial Sequence
  Synthetic
ccgttttttttttttaggtggac

SEQ ID NO: 16850 - DNA, 23 bp, Artificial Sequence
  Synthetic
ccgttttttttttttgttccccc

SEQ ID NO: 16851 - DNA, 23 bp, Artificial Sequence
  Synthetic
ccgttttttttttttgtcccccc

SEQ ID NO: 16852 - DNA, 23 bp, Artificial Sequence
  Synthetic
ccgttttttttttttgtcccccc

SEQ ID NO: 16853 - DNA, 23 bp, Artificial Sequence
  Synthetic
ccgttttttttttttgttccccc

SEQ ID NO: 16854 - DNA, 23 bp, Artificial Sequence
  Synthetic
ccgttttttttttttgttccccc

SEQ ID NO: 16855 - DNA, 23 bp, Artificial Sequence
  Synthetic
ccgttttttttttttgtcccccc

SEQ ID NO: 16856 - DNA, 23 bp, Artificial Sequence
  Synthetic
ccgttttttttttttgttcaaga

SEQ ID NO: 16857 - DNA, 23 bp, Artificial Sequence
  Synthetic
ccgttttttttttttgttcaaga

SEQ ID NO: 16858 - DNA, 23 bp, Artificial Sequence
  Synthetic
ccgttttttttttttcaacgctg

SEQ ID NO: 16859 - DNA, 23 bp, Artificial Sequence
  Synthetic
ccgttttttttttttcaacgatg

SEQ ID NO: 16860 - DNA, 23 bp, Artificial Sequence
  Synthetic
ccgttttttttttttggggtgac

SEQ ID NO: 16861 - DNA, 23 bp, Artificial Sequence
  Synthetic
ccgttttttttttttggggtgac

SEQ ID NO: 16862 - DNA, 23 bp, Artificial Sequence
  Synthetic
ccgttttttttttttggggtgac

SEQ ID NO: 16863 - DNA, 23 bp, Artificial Sequence
  Synthetic
ccgttttttttttttgggcaaat

SEQ ID NO: 16864 - DNA, 23 bp, Artificial Sequence
  Synthetic
ccgttttttttttttgggcaact

SEQ ID NO: 16865 - DNA, 23 bp, Artificial Sequence
  Synthetic
ccgttttttttttttgggcaact

SEQ ID NO: 16866 - DNA, 23 bp, Artificial Sequence
  Synthetic
ccgttttttttttttgggcaaat

SEQ ID NO: 16867 - DNA, 23 bp, Artificial Sequence
  Synthetic
ccgttttttttttttaggcaaat

SEQ ID NO: 16868 - DNA, 23 bp, Artificial Sequence
  Synthetic
ccgttttttttttttgggcaaat

SEQ ID NO: 16869 - DNA, 23 bp, Artificial Sequence
  Synthetic
ccgttttttttttttacttataa

SEQ ID NO: 16870 - DNA, 23 bp, Artificial Sequence
  Synthetic
ccgttttttttttttggtcgaca

SEQ ID NO: 16871 - DNA, 23 bp, Artificial Sequence
  Synthetic
ccgttttttttttttgaggttta

SEQ ID NO: 16872 - DNA, 23 bp, Artificial Sequence
  Synthetic
ccgttttttttttttagtttgtg

SEQ ID NO: 16873 - DNA, 23 bp, Artificial Sequence
  Synthetic
ccgttttttttttttgccgcaac

SEQ ID NO: 16874 - DNA, 23 bp, Artificial Sequence
  Synthetic
ccgttttttttttttatgggtta

SEQ ID NO: 16875 - DNA, 23 bp, Artificial Sequence
  Synthetic
ccgttttttttttttatgggtta

SEQ ID NO: 16876 - DNA, 23 bp, Artificial Sequence
  Synthetic
ccgttttttttttttatgggtta

SEQ ID NO: 16877 - DNA, 23 bp, Artificial Sequence
  Synthetic
ccgttttttttttttgattacaa

SEQ ID NO: 16878 - DNA, 23 bp, Artificial Sequence
  Synthetic
ccgttttttttttttcaaaagta

SEQ ID NO: 16879 - DNA, 23 bp, Artificial Sequence
  Synthetic
ccgttttttttttttcagggaag

SEQ ID NO: 16880 - DNA, 23 bp, Artificial Sequence
  Synthetic
ccgttttttttttttcagaacaa

SEQ ID NO: 16881 - DNA, 23 bp, Artificial Sequence
  Synthetic
ccgttttttttttttcgatgatg

SEQ ID NO: 16882 - DNA, 23 bp, Artificial Sequence
  Synthetic
ccgttttttttttttctgtttct

SEQ ID NO: 16883 - DNA, 23 bp, Artificial Sequence
  Synthetic
ccgttttttttttttacagtgta

SEQ ID NO: 16884 - DNA, 23 bp, Artificial Sequence
  Synthetic
ccgttttttttttttaacaaatt

SEQ ID NO: 16885 - DNA, 23 bp, Artificial Sequence
  Synthetic
ccgttttttttttttcagttcat

SEQ ID NO: 16886 - DNA, 23 bp, Artificial Sequence
  Synthetic
ccgttttttttttttacatcctc

SEQ ID NO: 16887 - DNA, 23 bp, Artificial Sequence
  Synthetic
ccgttttttttttttatttccgt

SEQ ID NO: 16888 - DNA, 23 bp, Artificial Sequence
  Synthetic
ccgttttttttttttaaggacaa

SEQ ID NO: 16889 - DNA, 23 bp, Artificial Sequence
  Synthetic
ccgttttttttttttacaaaaca

SEQ ID NO: 16890 - DNA, 23 bp, Artificial Sequence
  Synthetic
ccgttttttttttttacaaaaca

SEQ ID NO: 16891 - DNA, 23 bp, Artificial Sequence
  Synthetic
ccgttttttttttttacaaaaga

SEQ ID NO: 16892 - DNA, 23 bp, Artificial Sequence
  Synthetic
ccgttttttttttttgggctacc

SEQ ID NO: 16893 - DNA, 23 bp, Artificial Sequence
  Synthetic
ccgttttttttttttgggcggag

SEQ ID NO: 16894 - DNA, 23 bp, Artificial Sequence
  Synthetic
ccgttttttttttttgacaaaag

SEQ ID NO: 16895 - DNA, 23 bp, Artificial Sequence
  Synthetic
ccgttttttttttttggccatat

SEQ ID NO: 16896 - DNA, 23 bp, Artificial Sequence
  Synthetic
ccgttttttttttttcactgcta

SEQ ID NO: 16897 - DNA, 23 bp, Artificial Sequence
  Synthetic
ccgttttttttttttcatcaata

SEQ ID NO: 16898 - DNA, 23 bp, Artificial Sequence
  Synthetic
ccgttttttttttttcaacgaaa

SEQ ID NO: 16899 - DNA, 23 bp, Artificial Sequence
  Synthetic
ccgttttttttttttgtgtacat

SEQ ID NO: 16900 - DNA, 23 bp, Artificial Sequence
  Synthetic
ccgttttttttttttagcagcaa

SEQ ID NO: 16901 - DNA, 23 bp, Artificial Sequence
  Synthetic
ccgttttttttttttcagatatt

SEQ ID NO: 16902 - DNA, 23 bp, Artificial Sequence
  Synthetic
ccgttttttttttttgtatccag

SEQ ID NO: 16903 - DNA, 23 bp, Artificial Sequence
  Synthetic
ccgttttttttttttgaacatcc

SEQ ID NO: 16904 - DNA, 23 bp, Artificial Sequence
  Synthetic
ccgttttttttttttacatgaac

SEQ ID NO: 16905 - DNA, 23 bp, Artificial Sequence
  Synthetic
ccgttttttttttttatacaacc

SEQ ID NO: 16906 - DNA, 23 bp, Artificial Sequence
  Synthetic
ccgttttttttttttcatacttc

SEQ ID NO: 16907 - DNA, 23 bp, Artificial Sequence
  Synthetic
ccgttttttttttttaaattcgg

SEQ ID NO: 16908 - DNA, 23 bp, Artificial Sequence
  Synthetic
ccgttttttttttttgcattcac

SEQ ID NO: 16909 - DNA, 23 bp, Artificial Sequence
  Synthetic
ccgttttttttttttgagagaga

SEQ ID NO: 16910 - DNA, 23 bp, Artificial Sequence
  Synthetic
ccgttttttttttttaattcttc

SEQ ID NO: 16911 - DNA, 23 bp, Artificial Sequence
  Synthetic
ccgttttttttttttaattctcc

SEQ ID NO: 16912 - DNA, 23 bp, Artificial Sequence
  Synthetic
ccgttttttttttttcgcgctac

SEQ ID NO: 16913 - DNA, 23 bp, Artificial Sequence
  Synthetic
ccgttttttttttttaggaactc

SEQ ID NO: 16914 - DNA, 23 bp, Artificial Sequence
  Synthetic
ccgttttttttttttgtaccaga

SEQ ID NO: 16915 - DNA, 23 bp, Artificial Sequence
  Synthetic
ccgttttttttttttagtgtgga

SEQ ID NO: 16916 - DNA, 23 bp, Artificial Sequence
  Synthetic
ccgttttttttttttagacaaag

SEQ ID NO: 16917 - DNA, 23 bp, Artificial Sequence
  Synthetic
ccgttttttttttttaattacca

SEQ ID NO: 16918 - DNA, 23 bp, Artificial Sequence
  Synthetic
ccgttttttttttttgagcacct

SEQ ID NO: 16919 - DNA, 23 bp, Artificial Sequence
  Synthetic
ccgttttttttttttactcaagg

SEQ ID NO: 16920 - DNA, 23 bp, Artificial Sequence
  Synthetic
ccgttttttttttttgctatgcc

SEQ ID NO: 16921 - DNA, 23 bp, Artificial Sequence
  Synthetic
ccgttttttttttttaccagcta

SEQ ID NO: 16922 - DNA, 23 bp, Artificial Sequence
  Synthetic
ccgttttttttttttaacaaaat

SEQ ID NO: 16923 - DNA, 23 bp, Artificial Sequence
  Synthetic
ccgttttttttttttctacccat

SEQ ID NO: 16924 - DNA, 23 bp, Artificial Sequence
  Synthetic
ccgttttttttttttcatcttta

SEQ ID NO: 16925 - DNA, 23 bp, Artificial Sequence
  Synthetic
ccgttttttttttttacagctag

SEQ ID NO: 16926 - DNA, 23 bp, Artificial Sequence
  Synthetic
ccgttttttttttttctatacaa

SEQ ID NO: 16927 - DNA, 23 bp, Artificial Sequence
  Synthetic
ccgttttttttttttctatgcaa

SEQ ID NO: 16928 - DNA, 23 bp, Artificial Sequence
  Synthetic
ccgttttttttttttctatacaa

SEQ ID NO: 16929 - DNA, 23 bp, Artificial Sequence
  Synthetic
ccgttttttttttttctgtacaa

SEQ ID NO: 16930 - DNA, 23 bp, Artificial Sequence
  Synthetic
ccgttttttttttttcagcacaa

SEQ ID NO: 16931 - DNA, 23 bp, Artificial Sequence
  Synthetic
ccgttttttttttttgttatcac

SEQ ID NO: 16932 - DNA, 23 bp, Artificial Sequence
  Synthetic
ccgttttttttttttagccctgt

SEQ ID NO: 16933 - DNA, 23 bp, Artificial Sequence
  Synthetic
ccgttttttttttttctgcactg

SEQ ID NO: 16934 - DNA, 23 bp, Artificial Sequence
  Synthetic
ccgttttttttttttagccctgt

SEQ ID NO: 16935 - DNA, 23 bp, Artificial Sequence
  Synthetic
ccgttttttttttttcaaattcg

SEQ ID NO: 16936 - DNA, 23 bp, Artificial Sequence
  Synthetic
ccgttttttttttttcaaattcg

SEQ ID NO: 16937 - DNA, 23 bp, Artificial Sequence
  Synthetic
ccgttttttttttttaacaccat

SEQ ID NO: 16938 - DNA, 23 bp, Artificial Sequence
  Synthetic
ccgttttttttttttcattcacc

SEQ ID NO: 16939 - DNA, 23 bp, Artificial Sequence
  Synthetic
ccgttttttttttttcaggttaa

SEQ ID NO: 16940 - DNA, 23 bp, Artificial Sequence
  Synthetic
ccgttttttttttttcaagttag

SEQ ID NO: 16941 - DNA, 23 bp, Artificial Sequence
  Synthetic
ccgttttttttttttcattatta

SEQ ID NO: 16942 - DNA, 23 bp, Artificial Sequence
  Synthetic
ccgttttttttttttccaagctc

SEQ ID NO: 16943 - DNA, 23 bp, Artificial Sequence
  Synthetic
ccgttttttttttttaagagacc

SEQ ID NO: 16944 - DNA, 23 bp, Artificial Sequence
  Synthetic
ccgttttttttttttaccatggc

SEQ ID NO: 16945 - DNA, 23 bp, Artificial Sequence
  Synthetic
ccgttttttttttttgcctgatt

SEQ ID NO: 16946 - DNA, 23 bp, Artificial Sequence
  Synthetic
ccgttttttttttttggagacac

SEQ ID NO: 16947 - DNA, 23 bp, Artificial Sequence
  Synthetic
ccgttttttttttttgtggttct

SEQ ID NO: 16948 - DNA, 23 bp, Artificial Sequence
  Synthetic
ccgttttttttttttgtgctttc

SEQ ID NO: 16949 - DNA, 23 bp, Artificial Sequence
  Synthetic
ccgttttttttttttccataaag

SEQ ID NO: 16950 - DNA, 23 bp, Artificial Sequence
  Synthetic
ccgttttttttttttggattcct

SEQ ID NO: 16951 - DNA, 23 bp, Artificial Sequence
  Synthetic
ccgttttttttttttaaagttct

SEQ ID NO: 16952 - DNA, 23 bp, Artificial Sequence
  Synthetic
ccgttttttttttttaaagttct

SEQ ID NO: 16953 - DNA, 23 bp, Artificial Sequence
  Synthetic
ccgttttttttttttactggtac

SEQ ID NO: 16954 - DNA, 23 bp, Artificial Sequence
  Synthetic
ccgttttttttttttcaaggagc

SEQ ID NO: 16955 - DNA, 23 bp, Artificial Sequence
  Synthetic
ccgttttttttttttagactgtg

SEQ ID NO: 16956 - DNA, 23 bp, Artificial Sequence
  Synthetic
ccgttttttttttttaaccatga

SEQ ID NO: 16957 - DNA, 23 bp, Artificial Sequence
  Synthetic
ccgttttttttttttcaatattt

SEQ ID NO: 16958 - DNA, 23 bp, Artificial Sequence
  Synthetic
ccgttttttttttttaagtgcct

SEQ ID NO: 16959 - DNA, 23 bp, Artificial Sequence
  Synthetic
ccgttttttttttttacctgcac

SEQ ID NO: 16960 - DNA, 23 bp, Artificial Sequence
  Synthetic
ccgttttttttttttctcaccga

SEQ ID NO: 16961 - DNA, 23 bp, Artificial Sequence
  Synthetic
ccgttttttttttttacccaccg

SEQ ID NO: 16962 - DNA, 23 bp, Artificial Sequence
  Synthetic
ccgttttttttttttactcaccg

SEQ ID NO: 16963 - DNA, 23 bp, Artificial Sequence
  Synthetic
ccgttttttttttttcccaaaag

SEQ ID NO: 16964 - DNA, 23 bp, Artificial Sequence
  Synthetic
ccgttttttttttttgcactaga

SEQ ID NO: 16965 - DNA, 23 bp, Artificial Sequence
  Synthetic
ccgttttttttttttctgcacta

SEQ ID NO: 16966 - DNA, 23 bp, Artificial Sequence
  Synthetic
ccgttttttttttttgctgcttt

SEQ ID NO: 16967 - DNA, 23 bp, Artificial Sequence
  Synthetic
ccgttttttttttttgctgtcaa

SEQ ID NO: 16968 - DNA, 23 bp, Artificial Sequence
  Synthetic
ccgttttttttttttgggacttt

SEQ ID NO: 16969 - DNA, 23 bp, Artificial Sequence
  Synthetic
ccgttttttttttttctcgcccg

SEQ ID NO: 16970 - DNA, 23 bp, Artificial Sequence
  Synthetic
ccgttttttttttttcaggtagt

SEQ ID NO: 16971 - DNA, 23 bp, Artificial Sequence
  Synthetic
ccgttttttttttttccaatgtg

SEQ ID NO: 16972 - DNA, 23 bp, Artificial Sequence
  Synthetic
ccgttttttttttttacagatag

SEQ ID NO: 16973 - DNA, 23 bp, Artificial Sequence
  Synthetic
ccgttttttttttttcatcgtta

SEQ ID NO: 16974 - DNA, 23 bp, Artificial Sequence
  Synthetic
ccgttttttttttttcattacca

SEQ ID NO: 16975 - DNA, 23 bp, Artificial Sequence
  Synthetic
ccgttttttttttttatcattac

SEQ ID NO: 16976 - DNA, 23 bp, Artificial Sequence
  Synthetic
ccgttttttttttttgactccgg

SEQ ID NO: 16977 - DNA, 23 bp, Artificial Sequence
  Synthetic
ccgttttttttttttcctgcact

SEQ ID NO: 16978 - DNA, 23 bp, Artificial Sequence
  Synthetic
ccgttttttttttttctgcactg

SEQ ID NO: 16979 - DNA, 23 bp, Artificial Sequence
  Synthetic
ccgttttttttttttcaacatca

SEQ ID NO: 16980 - DNA, 23 bp, Artificial Sequence
  Synthetic
ccgttttttttttttacagccca

SEQ ID NO: 16981 - DNA, 23 bp, Artificial Sequence
  Synthetic
ccgttttttttttttgccgctgt

SEQ ID NO: 16982 - DNA, 23 bp, Artificial Sequence
  Synthetic
ccgttttttttttttgcctgtct

SEQ ID NO: 16983 - DNA, 23 bp, Artificial Sequence
  Synthetic
ccgttttttttttttgtcaattc

SEQ ID NO: 16984 - DNA, 23 bp, Artificial Sequence
  Synthetic
ccgttttttttttttatggttag

SEQ ID NO: 16985 - DNA, 23 bp, Artificial Sequence
  Synthetic
ccgttttttttttttagcttgcc

SEQ ID NO: 16986 - DNA, 23 bp, Artificial Sequence
  Synthetic
ccgttttttttttttacccagca

SEQ ID NO: 16987 - DNA, 23 bp, Artificial Sequence
  Synthetic
ccgttttttttttttccagtagc

SEQ ID NO: 16988 - DNA, 23 bp, Artificial Sequence
  Synthetic
ccgttttttttttttaaatccct

SEQ ID NO: 16989 - DNA, 23 bp, Artificial Sequence
  Synthetic
ccgttttttttttttgtaatccc

SEQ ID NO: 16990 - DNA, 23 bp, Artificial Sequence
  Synthetic
ccgttttttttttttcctgctga

SEQ ID NO: 16991 - DNA, 23 bp, Artificial Sequence
  Synthetic
ccgttttttttttttgaccgaga

SEQ ID NO: 16992 - DNA, 23 bp, Artificial Sequence
  Synthetic
ccgttttttttttttcctatcct

SEQ ID NO: 16993 - DNA, 23 bp, Artificial Sequence
  Synthetic
ccgttttttttttttcctatcct

SEQ ID NO: 16994 - DNA, 23 bp, Artificial Sequence
  Synthetic
ccgttttttttttttgaacttag

SEQ ID NO: 16995 - DNA, 23 bp, Artificial Sequence
  Synthetic
ccgttttttttttttagaactta

SEQ ID NO: 16996 - DNA, 23 bp, Artificial Sequence
  Synthetic
ccgttttttttttttccgatttc

SEQ ID NO: 16997 - DNA, 23 bp, Artificial Sequence
  Synthetic
ccgttttttttttttacactgat

SEQ ID NO: 16998 - DNA, 23 bp, Artificial Sequence
  Synthetic
ccgttttttttttttccgatttc

SEQ ID NO: 16999 - DNA, 23 bp, Artificial Sequence
  Synthetic
ccgttttttttttttcttccagt

SEQ ID NO: 17000 - DNA, 23 bp, Artificial Sequence
  Synthetic
ccgttttttttttttctgagtgt

SEQ ID NO: 17001 - DNA, 23 bp, Artificial Sequence
  Synthetic
ccgttttttttttttgagagtgt

SEQ ID NO: 17002 - DNA, 23 bp, Artificial Sequence
  Synthetic
ccgttttttttttttcttccagt

SEQ ID NO: 17003 - DNA, 23 bp, Artificial Sequence
  Synthetic
ccgttttttttttttcttccagt

SEQ ID NO: 17004 - DNA, 23 bp, Artificial Sequence
  Synthetic
ccgttttttttttttctatgcca

SEQ ID NO: 17005 - DNA, 23 bp, Artificial Sequence
  Synthetic
ccgttttttttttttccctctca

SEQ ID NO: 17006 - DNA, 23 bp, Artificial Sequence
  Synthetic
ccgttttttttttttatgggtgc

SEQ ID NO: 17007 - DNA, 23 bp, Artificial Sequence
  Synthetic
ccgttttttttttttcactggac

SEQ ID NO: 17008 - DNA, 23 bp, Artificial Sequence
  Synthetic
ccgttttttttttttatcagcta

SEQ ID NO: 17009 - DNA, 23 bp, Artificial Sequence
  Synthetic
ccgttttttttttttatcagcta

SEQ ID NO: 17010 - DNA, 23 bp, Artificial Sequence
  Synthetic
ccgttttttttttttcccctgga

SEQ ID NO: 17011 - DNA, 23 bp, Artificial Sequence
  Synthetic
ccgttttttttttttcagatgga

SEQ ID NO: 17012 - DNA, 23 bp, Artificial Sequence
  Synthetic
ccgttttttttttttagatcaac

SEQ ID NO: 17013 - DNA, 23 bp, Artificial Sequence
  Synthetic
ccgttttttttttttgaatataa

SEQ ID NO: 17014 - DNA, 23 bp, Artificial Sequence
  Synthetic
ccgttttttttttttacgtggac

SEQ ID NO: 17015 - DNA, 23 bp, Artificial Sequence
  Synthetic
ccgttttttttttttgcatgttc

SEQ ID NO: 17016 - DNA, 23 bp, Artificial Sequence
  Synthetic
ccgttttttttttttgaggggcc

SEQ ID NO: 17017 - DNA, 23 bp, Artificial Sequence
  Synthetic
ccgttttttttttttgcggacac

SEQ ID NO: 17018 - DNA, 23 bp, Artificial Sequence
  Synthetic
ccgttttttttttttacgggagt

SEQ ID NO: 17019 - DNA, 23 bp, Artificial Sequence
  Synthetic
ccgttttttttttttaggaacac

SEQ ID NO: 17020 - DNA, 23 bp, Artificial Sequence
  Synthetic
ccgttttttttttttgtagtcca

SEQ ID NO: 17021 - DNA, 23 bp, Artificial Sequence
  Synthetic
ccgttttttttttttgtatatgc

SEQ ID NO: 17022 - DNA, 23 bp, Artificial Sequence
  Synthetic
ccgttttttttttttgggagggg

SEQ ID NO: 17023 - DNA, 23 bp, Artificial Sequence
  Synthetic
ccgttttttttttttggatgtcc

SEQ ID NO: 17024 - DNA, 23 bp, Artificial Sequence
  Synthetic
ccgttttttttttttgtggatga

SEQ ID NO: 17025 - DNA, 23 bp, Artificial Sequence
  Synthetic
ccgttttttttttttacatcact

SEQ ID NO: 17026 - DNA, 23 bp, Artificial Sequence
  Synthetic
ccgttttttttttttggtcctac

SEQ ID NO: 17027 - DNA, 23 bp, Artificial Sequence
  Synthetic
ccgttttttttttttccaataaa

SEQ ID NO: 17028 - DNA, 23 bp, Artificial Sequence
  Synthetic
ccgttttttttttttcacaataa

SEQ ID NO: 17029 - DNA, 23 bp, Artificial Sequence
  Synthetic
ccgttttttttttttcaacaaaa

SEQ ID NO: 17030 - DNA, 23 bp, Artificial Sequence
  Synthetic
ccgttttttttttttaggccggg

SEQ ID NO: 17031 - DNA, 23 bp, Artificial Sequence
  Synthetic
ccgttttttttttttctgcacga

SEQ ID NO: 17032 - DNA, 23 bp, Artificial Sequence
  Synthetic
ccgttttttttttttcaatacaa

SEQ ID NO: 17033 - DNA, 23 bp, Artificial Sequence
  Synthetic
ccgttttttttttttaagatcgg

SEQ ID NO: 17034 - DNA, 23 bp, Artificial Sequence
  Synthetic
ccgttttttttttttctatacaa

SEQ ID NO: 17035 - DNA, 23 bp, Artificial Sequence
  Synthetic
ccgttttttttttttcacttgag

SEQ ID NO: 17036 - DNA, 23 bp, Artificial Sequence
  Synthetic
ccgttttttttttttgaatgcgt

SEQ ID NO: 17037 - DNA, 23 bp, Artificial Sequence
  Synthetic
ccgttttttttttttatacttct

SEQ ID NO: 17038 - DNA, 23 bp, Artificial Sequence
  Synthetic
ccgttttttttttttcattcacc

SEQ ID NO: 17039 - DNA, 23 bp, Artificial Sequence
  Synthetic
ccgttttttttttttgtgaattc

SEQ ID NO: 17040 - DNA, 23 bp, Artificial Sequence
  Synthetic
ccgttttttttttttggtcgcac

SEQ ID NO: 17041 - DNA, 23 bp, Artificial Sequence
  Synthetic
ccgttttttttttttgcctgttg

SEQ ID NO: 17042 - DNA, 23 bp, Artificial Sequence
  Synthetic
ccgttttttttttttccgcagtt

SEQ ID NO: 17043 - DNA, 23 bp, Artificial Sequence
  Synthetic
ccgttttttttttttcgcacatg

SEQ ID NO: 17044 - DNA, 23 bp, Artificial Sequence
  Synthetic
ccgttttttttttttgggtattc

SEQ ID NO: 17045 - DNA, 23 bp, Artificial Sequence
  Synthetic
ccgttttttttttttcgtcatta

SEQ ID NO: 17046 - DNA, 23 bp, Artificial Sequence
  Synthetic
ccgttttttttttttagtaccta

SEQ ID NO: 17047 - DNA, 23 bp, Artificial Sequence
  Synthetic
ccgttttttttttttgtactttt

SEQ ID NO: 17048 - DNA, 23 bp, Artificial Sequence
  Synthetic
ccgttttttttttttcgaaaatt

SEQ ID NO: 17049 - DNA, 23 bp, Artificial Sequence
  Synthetic
ccgttttttttttttctcacacc

SEQ ID NO: 17050 - DNA, 23 bp, Artificial Sequence
  Synthetic
ccgttttttttttttaccacttt

SEQ ID NO: 17051 - DNA, 23 bp, Artificial Sequence
  Synthetic
ccgttttttttttttgctacttg

SEQ ID NO: 17052 - DNA, 23 bp, Artificial Sequence
  Synthetic
ccgttttttttttttctcctacc

SEQ ID NO: 17053 - DNA, 23 bp, Artificial Sequence
  Synthetic
ccgttttttttttttgcgttatc

SEQ ID NO: 17054 - DNA, 23 bp, Artificial Sequence
  Synthetic
ccgttttttttttttaacactca

SEQ ID NO: 17055 - DNA, 23 bp, Artificial Sequence
  Synthetic
ccgttttttttttttgtgccaac

SEQ ID NO: 17056 - DNA, 23 bp, Artificial Sequence
  Synthetic
ccgttttttttttttaagagcgg

SEQ ID NO: 17057 - DNA, 23 bp, Artificial Sequence
  Synthetic
ccgttttttttttttcctgcggc

SEQ ID NO: 17058 - DNA, 23 bp, Artificial Sequence
  Synthetic
ccgttttttttttttagtgttag

SEQ ID NO: 17059 - DNA, 23 bp, Artificial Sequence
  Synthetic
ccgttttttttttttcagttgca

SEQ ID NO: 17060 - DNA, 23 bp, Artificial Sequence
  Synthetic
ccgttttttttttttccagatta

SEQ ID NO: 17061 - DNA, 23 bp, Artificial Sequence
  Synthetic
ccgttttttttttttcaaaactg

SEQ ID NO: 17062 - DNA, 23 bp, Artificial Sequence
  Synthetic
ccgttttttttttttaccagcta

SEQ ID NO: 17063 - DNA, 23 bp, Artificial Sequence
  Synthetic
ccgttttttttttttcaagtttt

SEQ ID NO: 17064 - DNA, 23 bp, Artificial Sequence
  Synthetic
ccgttttttttttttaccaacac

SEQ ID NO: 17065 - DNA, 23 bp, Artificial Sequence
  Synthetic
ccgttttttttttttgagcagca

SEQ ID NO: 17066 - DNA, 23 bp, Artificial Sequence
  Synthetic
ccgttttttttttttagctcagg

SEQ ID NO: 17067 - DNA, 23 bp, Artificial Sequence
  Synthetic
ccgttttttttttttatttgttc

SEQ ID NO: 17068 - DNA, 23 bp, Artificial Sequence
  Synthetic
ccgttttttttttttgtcaatga

SEQ ID NO: 17069 - DNA, 23 bp, Artificial Sequence
  Synthetic
ccgttttttttttttacgactaa

SEQ ID NO: 17070 - DNA, 23 bp, Artificial Sequence
  Synthetic
ccgttttttttttttcgaatttt

SEQ ID NO: 17071 - DNA, 23 bp, Artificial Sequence
  Synthetic
ccgttttttttttttaacgggat

SEQ ID NO: 17072 - DNA, 23 bp, Artificial Sequence
  Synthetic
ccgttttttttttttccaggttg

SEQ ID NO: 17073 - DNA, 23 bp, Artificial Sequence
  Synthetic
ccgttttttttttttaccgtttt

SEQ ID NO: 17074 - DNA, 23 bp, Artificial Sequence
  Synthetic
ccgttttttttttttgctgattg

SEQ ID NO: 17075 - DNA, 23 bp, Artificial Sequence
  Synthetic
ccgttttttttttttgagttttt

SEQ ID NO: 17076 - DNA, 23 bp, Artificial Sequence
  Synthetic
ccgttttttttttttagatgtta

SEQ ID NO: 17077 - DNA, 23 bp, Artificial Sequence
  Synthetic
ccgttttttttttttgacagcaa

SEQ ID NO: 17078 - DNA, 23 bp, Artificial Sequence
  Synthetic
ccgttttttttttttctgaatgt

SEQ ID NO: 17079 - DNA, 23 bp, Artificial Sequence
  Synthetic
ccgttttttttttttctgaatgt

SEQ ID NO: 17080 - DNA, 23 bp, Artificial Sequence
  Synthetic
ccgttttttttttttagagagcg

SEQ ID NO: 17081 - DNA, 23 bp, Artificial Sequence
  Synthetic
ccgttttttttttttagagagcg

SEQ ID NO: 17082 - DNA, 23 bp, Artificial Sequence
  Synthetic
ccgttttttttttttcatctact

SEQ ID NO: 17083 - DNA, 23 bp, Artificial Sequence
  Synthetic
ccgttttttttttttcagcttct

SEQ ID NO: 17084 - DNA, 23 bp, Artificial Sequence
  Synthetic
ccgttttttttttttcccaagaa

SEQ ID NO: 17085 - DNA, 23 bp, Artificial Sequence
  Synthetic
ccgttttttttttttcatggcaa

SEQ ID NO: 17086 - DNA, 23 bp, Artificial Sequence
  Synthetic
ccgttttttttttttcacggaaa

SEQ ID NO: 17087 - DNA, 23 bp, Artificial Sequence
  Synthetic
ccgttttttttttttggcagaaa

SEQ ID NO: 17088 - DNA, 23 bp, Artificial Sequence
  Synthetic
ccgttttttttttttacacagct

SEQ ID NO: 17089 - DNA, 23 bp, Artificial Sequence
  Synthetic
ccgttttttttttttccgtactg

SEQ ID NO: 17090 - DNA, 23 bp, Artificial Sequence
  Synthetic
ccgttttttttttttactagaaa

SEQ ID NO: 17091 - DNA, 23 bp, Artificial Sequence
  Synthetic
ccgttttttttttttgcagagtc

SEQ ID NO: 17092 - DNA, 23 bp, Artificial Sequence
  Synthetic
ccgttttttttttttaagctaga

SEQ ID NO: 17093 - DNA, 23 bp, Artificial Sequence
  Synthetic
ccgttttttttttttgtacacgc

SEQ ID NO: 17094 - DNA, 23 bp, Artificial Sequence
  Synthetic
ccgttttttttttttctctttct

SEQ ID NO: 17095 - DNA, 23 bp, Artificial Sequence
  Synthetic
ccgttttttttttttggaacacc

SEQ ID NO: 17096 - DNA, 23 bp, Artificial Sequence
  Synthetic
ccgttttttttttttctacccat

SEQ ID NO: 17097 - DNA, 23 bp, Artificial Sequence
  Synthetic
ccgttttttttttttatgccaac

SEQ ID NO: 17098 - DNA, 23 bp, Artificial Sequence
  Synthetic
ccgttttttttttttgaactgcc

SEQ ID NO: 17099 - DNA, 23 bp, Artificial Sequence
  Synthetic
ccgttttttttttttgactgcca

SEQ ID NO: 17100 - DNA, 23 bp, Artificial Sequence
  Synthetic
ccgttttttttttttaggcggtt

SEQ ID NO: 17101 - DNA, 23 bp, Artificial Sequence
  Synthetic
ccgttttttttttttacagctat

SEQ ID NO: 17102 - DNA, 23 bp, Artificial Sequence
  Synthetic
ccgttttttttttttctttggta

SEQ ID NO: 17103 - DNA, 23 bp, Artificial Sequence
  Synthetic
ccgttttttttttttgctttcaa

SEQ ID NO: 17104 - DNA, 23 bp, Artificial Sequence
  Synthetic
ccgttttttttttttagctttca

SEQ ID NO: 17105 - DNA, 23 bp, Artificial Sequence
  Synthetic
ccgttttttttttttggctttca

SEQ ID NO: 17106 - DNA, 23 bp, Artificial Sequence
  Synthetic
ccgttttttttttttactgaatt

SEQ ID NO: 17107 - DNA, 23 bp, Artificial Sequence
  Synthetic
ccgttttttttttttcagcattg

SEQ ID NO: 17108 - DNA, 23 bp, Artificial Sequence
  Synthetic
ccgttttttttttttacgccttt

SEQ ID NO: 17109 - DNA, 23 bp, Artificial Sequence
  Synthetic
ccgttttttttttttctgtggca

SEQ ID NO: 17110 - DNA, 23 bp, Artificial Sequence
  Synthetic
ccgttttttttttttacctgaaa

SEQ ID NO: 17111 - DNA, 23 bp, Artificial Sequence
  Synthetic
ccgttttttttttttggcattca

SEQ ID NO: 17112 - DNA, 23 bp, Artificial Sequence
  Synthetic
ccgttttttttttttctatacaa

SEQ ID NO: 17113 - DNA, 23 bp, Artificial Sequence
  Synthetic
ccgttttttttttttcacttgag

SEQ ID NO: 17114 - DNA, 23 bp, Artificial Sequence
  Synthetic
ccgttttttttttttaaatgcgt

SEQ ID NO: 17115 - DNA, 23 bp, Artificial Sequence
  Synthetic
ccgttttttttttttatacttct

SEQ ID NO: 17116 - DNA, 23 bp, Artificial Sequence
  Synthetic
ccgttttttttttttcattcacc

SEQ ID NO: 17117 - DNA, 23 bp, Artificial Sequence
  Synthetic
ccgttttttttttttacatcaaa

SEQ ID NO: 17118 - DNA, 23 bp, Artificial Sequence
  Synthetic
ccgttttttttttttagaatcat

SEQ ID NO: 17119 - DNA, 23 bp, Artificial Sequence
  Synthetic
ccgttttttttttttgtgaattc

SEQ ID NO: 17120 - DNA, 23 bp, Artificial Sequence
  Synthetic
ccgttttttttttttgatggaaa

SEQ ID NO: 17121 - DNA, 23 bp, Artificial Sequence
  Synthetic
ccgttttttttttttctggtcgc

SEQ ID NO: 17122 - DNA, 23 bp, Artificial Sequence
  Synthetic
ccgttttttttttttcctgttga

SEQ ID NO: 17123 - DNA, 23 bp, Artificial Sequence
  Synthetic
ccgttttttttttttccgcagtt

SEQ ID NO: 17124 - DNA, 23 bp, Artificial Sequence
  Synthetic
ccgttttttttttttcgcacatg

SEQ ID NO: 17125 - DNA, 23 bp, Artificial Sequence
  Synthetic
ccgttttttttttttgggtattc

SEQ ID NO: 17126 - DNA, 23 bp, Artificial Sequence
  Synthetic
ccgttttttttttttggccgggg

SEQ ID NO: 17127 - DNA, 23 bp, Artificial Sequence
  Synthetic
ccgttttttttttttcgtcatta

SEQ ID NO: 17128 - DNA, 23 bp, Artificial Sequence
  Synthetic
ccgttttttttttttgctgttcg

SEQ ID NO: 17129 - DNA, 23 bp, Artificial Sequence
  Synthetic
ccgttttttttttttaatggcat

SEQ ID NO: 17130 - DNA, 23 bp, Artificial Sequence
  Synthetic
ccgttttttttttttagtaccta

SEQ ID NO: 17131 - DNA, 23 bp, Artificial Sequence
  Synthetic
ccgttttttttttttgtactttt

SEQ ID NO: 17132 - DNA, 23 bp, Artificial Sequence
  Synthetic
ccgttttttttttttcgaagatt

SEQ ID NO: 17133 - DNA, 23 bp, Artificial Sequence
  Synthetic
ccgttttttttttttctcgcacc

SEQ ID NO: 17134 - DNA, 23 bp, Artificial Sequence
  Synthetic
ccgttttttttttttaagcaaag

SEQ ID NO: 17135 - DNA, 23 bp, Artificial Sequence
  Synthetic
ccgttttttttttttatcccgcc

SEQ ID NO: 17136 - DNA, 23 bp, Artificial Sequence
  Synthetic
ccgttttttttttttaccacttt

SEQ ID NO: 17137 - DNA, 23 bp, Artificial Sequence
  Synthetic
ccgttttttttttttgctacttg

SEQ ID NO: 17138 - DNA, 23 bp, Artificial Sequence
  Synthetic
ccgttttttttttttctcctacc

SEQ ID NO: 17139 - DNA, 23 bp, Artificial Sequence
  Synthetic
ccgttttttttttttgaagagaa

SEQ ID NO: 17140 - DNA, 23 bp, Artificial Sequence
  Synthetic
ccgttttttttttttgcgttatc

SEQ ID NO: 17141 - DNA, 23 bp, Artificial Sequence
  Synthetic
ccgttttttttttttaacgctca

SEQ ID NO: 17142 - DNA, 23 bp, Artificial Sequence
  Synthetic
ccgttttttttttttatgccaac

SEQ ID NO: 17143 - DNA, 23 bp, Artificial Sequence
  Synthetic
ccgttttttttttttaagagcgg

SEQ ID NO: 17144 - DNA, 23 bp, Artificial Sequence
  Synthetic
ccgttttttttttttcctgcggc

SEQ ID NO: 17145 - DNA, 23 bp, Artificial Sequence
  Synthetic
ccgttttttttttttcagtgtta

SEQ ID NO: 17146 - DNA, 23 bp, Artificial Sequence
  Synthetic
ccgttttttttttttacagtcgc

SEQ ID NO: 17147 - DNA, 23 bp, Artificial Sequence
  Synthetic
ccgttttttttttttagtcttct

SEQ ID NO: 17148 - DNA, 23 bp, Artificial Sequence
  Synthetic
ccgttttttttttttctgggtac

SEQ ID NO: 17149 - DNA, 23 bp, Artificial Sequence
  Synthetic
ccgttttttttttttaaggattc

SEQ ID NO: 17150 - DNA, 23 bp, Artificial Sequence
  Synthetic
ccgttttttttttttcagattag

SEQ ID NO: 17151 - DNA, 23 bp, Artificial Sequence
  Synthetic
ccgttttttttttttcaagagtt

SEQ ID NO: 17152 - DNA, 23 bp, Artificial Sequence
  Synthetic
ccgttttttttttttgaaaacta

SEQ ID NO: 17153 - DNA, 23 bp, Artificial Sequence
  Synthetic
ccgttttttttttttagaaaaca

SEQ ID NO: 17154 - DNA, 23 bp, Artificial Sequence
  Synthetic
ccgttttttttttttaacaacaa

SEQ ID NO: 17155 - DNA, 23 bp, Artificial Sequence
  Synthetic
ccgttttttttttttccaccctt

SEQ ID NO: 17156 - DNA, 23 bp, Artificial Sequence
  Synthetic
ccgttttttttttttgccaaagt

SEQ ID NO: 17157 - DNA, 23 bp, Artificial Sequence
  Synthetic
ccgttttttttttttagcagaca

SEQ ID NO: 17158 - DNA, 23 bp, Artificial Sequence
  Synthetic
ccgttttttttttttcaaactgc

SEQ ID NO: 17159 - DNA, 23 bp, Artificial Sequence
  Synthetic
ccgttttttttttttgccagagt

SEQ ID NO: 17160 - DNA, 23 bp, Artificial Sequence
  Synthetic
ccgttttttttttttcactgcta

SEQ ID NO: 17161 - DNA, 23 bp, Artificial Sequence
  Synthetic
ccgttttttttttttgctttccc

SEQ ID NO: 17162 - DNA, 23 bp, Artificial Sequence
  Synthetic
ccgttttttttttttaacaccca

SEQ ID NO: 17163 - DNA, 23 bp, Artificial Sequence
  Synthetic
ccgttttttttttttgccgacac

SEQ ID NO: 17164 - DNA, 23 bp, Artificial Sequence
  Synthetic
ccgttttttttttttaccagcta

SEQ ID NO: 17165 - DNA, 23 bp, Artificial Sequence
  Synthetic
ccgttttttttttttgctagttt

SEQ ID NO: 17166 - DNA, 23 bp, Artificial Sequence
  Synthetic
ccgttttttttttttaccaacac

SEQ ID NO: 17167 - DNA, 23 bp, Artificial Sequence
  Synthetic
ccgttttttttttttgagcagca

SEQ ID NO: 17168 - DNA, 23 bp, Artificial Sequence
  Synthetic
ccgttttttttttttagctcagg

SEQ ID NO: 17169 - DNA, 23 bp, Artificial Sequence
  Synthetic
ccgttttttttttttgttcgcgt

SEQ ID NO: 17170 - DNA, 23 bp, Artificial Sequence
  Synthetic
ccgttttttttttttgcaacgac

SEQ ID NO: 17171 - DNA, 23 bp, Artificial Sequence
  Synthetic
ccgttttttttttttgacaggga

SEQ ID NO: 17172 - DNA, 23 bp, Artificial Sequence
  Synthetic
ccgttttttttttttcagagaaa

SEQ ID NO: 17173 - DNA, 23 bp, Artificial Sequence
  Synthetic
ccgttttttttttttgcgaattt

SEQ ID NO: 17174 - DNA, 23 bp, Artificial Sequence
  Synthetic
ccgttttttttttttaacgggat

SEQ ID NO: 17175 - DNA, 23 bp, Artificial Sequence
  Synthetic
ccgttttttttttttgcaagtgt

SEQ ID NO: 17176 - DNA, 23 bp, Artificial Sequence
  Synthetic
ccgttttttttttttccagtttt

SEQ ID NO: 17177 - DNA, 23 bp, Artificial Sequence
  Synthetic
ccgttttttttttttagctgatt

SEQ ID NO: 17178 - DNA, 23 bp, Artificial Sequence
  Synthetic
ccgttttttttttttcacacgtg

SEQ ID NO: 17179 - DNA, 23 bp, Artificial Sequence
  Synthetic
ccgttttttttttttctgatgta

SEQ ID NO: 17180 - DNA, 23 bp, Artificial Sequence
  Synthetic
ccgttttttttttttgtgatttt

SEQ ID NO: 17181 - DNA, 23 bp, Artificial Sequence
  Synthetic
ccgttttttttttttagatgtta

SEQ ID NO: 17182 - DNA, 23 bp, Artificial Sequence
  Synthetic
ccgttttttttttttgacagcaa

SEQ ID NO: 17183 - DNA, 23 bp, Artificial Sequence
  Synthetic
ccgttttttttttttctgaatgt

SEQ ID NO: 17184 - DNA, 23 bp, Artificial Sequence
  Synthetic
ccgttttttttttttctgaatgt

SEQ ID NO: 17185 - DNA, 23 bp, Artificial Sequence
  Synthetic
ccgttttttttttttagagagcg

SEQ ID NO: 17186 - DNA, 23 bp, Artificial Sequence
  Synthetic
ccgttttttttttttagagagcg

SEQ ID NO: 17187 - DNA, 23 bp, Artificial Sequence
  Synthetic
ccgttttttttttttcatctact

SEQ ID NO: 17188 - DNA, 23 bp, Artificial Sequence
  Synthetic
ccgttttttttttttcagcttct

SEQ ID NO: 17189 - DNA, 23 bp, Artificial Sequence
  Synthetic
ccgttttttttttttcccaagaa

SEQ ID NO: 17190 - DNA, 23 bp, Artificial Sequence
  Synthetic
ccgttttttttttttcatggata

SEQ ID NO: 17191 - DNA, 23 bp, Artificial Sequence
  Synthetic
ccgttttttttttttcacggaaa

SEQ ID NO: 17192 - DNA, 23 bp, Artificial Sequence
  Synthetic
ccgttttttttttttcacggaaa

SEQ ID NO: 17193 - DNA, 23 bp, Artificial Sequence
  Synthetic
ccgttttttttttttggattatg

SEQ ID NO: 17194 - DNA, 23 bp, Artificial Sequence
  Synthetic
ccgttttttttttttagcagaaa

SEQ ID NO: 17195 - DNA, 23 bp, Artificial Sequence
  Synthetic
ccgttttttttttttagcggaaa

SEQ ID NO: 17196 - DNA, 23 bp, Artificial Sequence
  Synthetic
ccgttttttttttttaacccaaa

SEQ ID NO: 17197 - DNA, 23 bp, Artificial Sequence
  Synthetic
ccgttttttttttttacacagct

SEQ ID NO: 17198 - DNA, 23 bp, Artificial Sequence
  Synthetic
ccgttttttttttttccgtactg

SEQ ID NO: 17199 - DNA, 23 bp, Artificial Sequence
  Synthetic
ccgttttttttttttcatcctga

SEQ ID NO: 17200 - DNA, 23 bp, Artificial Sequence
  Synthetic
ccgttttttttttttactagaaa

SEQ ID NO: 17201 - DNA, 23 bp, Artificial Sequence
  Synthetic
ccgttttttttttttgatgagta

SEQ ID NO: 17202 - DNA, 23 bp, Artificial Sequence
  Synthetic
ccgttttttttttttaagctaga

SEQ ID NO: 17203 - DNA, 23 bp, Artificial Sequence
  Synthetic
ccgttttttttttttaactcgct

SEQ ID NO: 17204 - DNA, 23 bp, Artificial Sequence
  Synthetic
ccgttttttttttttgtaacgct

SEQ ID NO: 17205 - DNA, 23 bp, Artificial Sequence
  Synthetic
ccgttttttttttttgttacgct

SEQ ID NO: 17206 - DNA, 23 bp, Artificial Sequence
  Synthetic
ccgttttttttttttcatcccta

SEQ ID NO: 17207 - DNA, 23 bp, Artificial Sequence
  Synthetic
ccgttttttttttttctctttct

SEQ ID NO: 17208 - DNA, 23 bp, Artificial Sequence
  Synthetic
ccgttttttttttttgaaacacc

SEQ ID NO: 17209 - DNA, 23 bp, Artificial Sequence
  Synthetic
ccgttttttttttttctacccat

SEQ ID NO: 17210 - DNA, 23 bp, Artificial Sequence
  Synthetic
ccgttttttttttttatgccaac

SEQ ID NO: 17211 - DNA, 23 bp, Artificial Sequence
  Synthetic
ccgttttttttttttgaactgcc

SEQ ID NO: 17212 - DNA, 23 bp, Artificial Sequence
  Synthetic
ccgttttttttttttgactgcca

SEQ ID NO: 17213 - DNA, 23 bp, Artificial Sequence
  Synthetic
ccgttttttttttttagccggtt

SEQ ID NO: 17214 - DNA, 23 bp, Artificial Sequence
  Synthetic
ccgttttttttttttaggcttca

SEQ ID NO: 17215 - DNA, 23 bp, Artificial Sequence
  Synthetic
ccgttttttttttttacagctat

SEQ ID NO: 17216 - DNA, 23 bp, Artificial Sequence
  Synthetic
ccgttttttttttttacaaacaa

SEQ ID NO: 17217 - DNA, 23 bp, Artificial Sequence
  Synthetic
ccgttttttttttttctttggta

SEQ ID NO: 17218 - DNA, 23 bp, Artificial Sequence
  Synthetic
ccgttttttttttttgctttcaa

SEQ ID NO: 17219 - DNA, 23 bp, Artificial Sequence
  Synthetic
ccgttttttttttttagctttca

SEQ ID NO: 17220 - DNA, 23 bp, Artificial Sequence
  Synthetic
ccgttttttttttttggctttca

SEQ ID NO: 17221 - DNA, 23 bp, Artificial Sequence
  Synthetic
ccgttttttttttttgaatttat

SEQ ID NO: 17222 - DNA, 23 bp, Artificial Sequence
  Synthetic
ccgttttttttttttaatattac

SEQ ID NO: 17223 - DNA, 23 bp, Artificial Sequence
  Synthetic
ccgttttttttttttacgacttt

SEQ ID NO: 17224 - DNA, 23 bp, Artificial Sequence
  Synthetic
ccgttttttttttttctgtggca

SEQ ID NO: 17225 - DNA, 23 bp, Artificial Sequence
  Synthetic
ccgttttttttttttacctgaaa

SEQ ID NO: 17226 - DNA, 23 bp, Artificial Sequence
  Synthetic
ccgttttttttttttggcattca

SEQ ID NO: 17227 - DNA, 23 bp, Artificial Sequence
  Synthetic
ccgttttttttttttaggatttt

SEQ ID NO: 17228 - DNA, 23 bp, Artificial Sequence
  Synthetic
ccgttttttttttttggcattac

SEQ ID NO: 17229 - DNA, 23 bp, Artificial Sequence
  Synthetic
ccgttttttttttttggacatcc

SEQ ID NO: 17230 - DNA, 23 bp, Artificial Sequence
  Synthetic
ccgttttttttttttcagctaac

SEQ ID NO: 17231 - DNA, 23 bp, Artificial Sequence
  Synthetic
ccgttttttttttttggaacaca

SEQ ID NO: 17232 - DNA, 23 bp, Artificial Sequence
  Synthetic
ccgttttttttttttcagctttc

SEQ ID NO: 17233 - DNA, 23 bp, Artificial Sequence
  Synthetic
ccgttttttttttttatacaacc

SEQ ID NO: 17234 - DNA, 23 bp, Artificial Sequence
  Synthetic
ccgttttttttttttcatacttc

SEQ ID NO: 17235 - DNA, 23 bp, Artificial Sequence
  Synthetic
ccgttttttttttttaaattcgg

SEQ ID NO: 17236 - DNA, 23 bp, Artificial Sequence
  Synthetic
ccgttttttttttttcaagttcg

SEQ ID NO: 17237 - DNA, 23 bp, Artificial Sequence
  Synthetic
ccgttttttttttttaagaactc

SEQ ID NO: 17238 - DNA, 23 bp, Artificial Sequence
  Synthetic
ccgttttttttttttcagtacct

SEQ ID NO: 17239 - DNA, 23 bp, Artificial Sequence
  Synthetic
ccgttttttttttttgcattcac

SEQ ID NO: 17240 - DNA, 23 bp, Artificial Sequence
  Synthetic
ccgttttttttttttcaagttag

SEQ ID NO: 17241 - DNA, 23 bp, Artificial Sequence
  Synthetic
ccgttttttttttttagctggtt

SEQ ID NO: 17242 - DNA, 23 bp, Artificial Sequence
  Synthetic
ccgttttttttttttcatcaaaa

SEQ ID NO: 17243 - DNA, 23 bp, Artificial Sequence
  Synthetic
ccgttttttttttttcgtcaaaa

SEQ ID NO: 17244 - DNA, 23 bp, Artificial Sequence
  Synthetic
ccgttttttttttttgagagaga

SEQ ID NO: 17245 - DNA, 23 bp, Artificial Sequence
  Synthetic
ccgttttttttttttccttatca

SEQ ID NO: 17246 - DNA, 23 bp, Artificial Sequence
  Synthetic
ccgttttttttttttgggcgaga

SEQ ID NO: 17247 - DNA, 23 bp, Artificial Sequence
  Synthetic
ccgttttttttttttccgctgtc

SEQ ID NO: 17248 - DNA, 23 bp, Artificial Sequence
  Synthetic
ccgttttttttttttagaattgc

SEQ ID NO: 17249 - DNA, 23 bp, Artificial Sequence
  Synthetic
ccgttttttttttttaattcttc

SEQ ID NO: 17250 - DNA, 23 bp, Artificial Sequence
  Synthetic
ccgttttttttttttaattctcc

SEQ ID NO: 17251 - DNA, 23 bp, Artificial Sequence
  Synthetic
ccgttttttttttttcccgttag

SEQ ID NO: 17252 - DNA, 23 bp, Artificial Sequence
  Synthetic
ccgttttttttttttcgcgctac

SEQ ID NO: 17253 - DNA, 23 bp, Artificial Sequence
  Synthetic
ccgttttttttttttaggaactc

SEQ ID NO: 17254 - DNA, 23 bp, Artificial Sequence
  Synthetic
ccgttttttttttttagcacggt

SEQ ID NO: 17255 - DNA, 23 bp, Artificial Sequence
  Synthetic
ccgttttttttttttagcacggt

SEQ ID NO: 17256 - DNA, 23 bp, Artificial Sequence
  Synthetic
ccgttttttttttttgtaccaga

SEQ ID NO: 17257 - DNA, 23 bp, Artificial Sequence
  Synthetic
ccgttttttttttttacggacga

SEQ ID NO: 17258 - DNA, 23 bp, Artificial Sequence
  Synthetic
ccgttttttttttttgagtgtgg

SEQ ID NO: 17259 - DNA, 23 bp, Artificial Sequence
  Synthetic
ccgttttttttttttatttcata

SEQ ID NO: 17260 - DNA, 23 bp, Artificial Sequence
  Synthetic
ccgttttttttttttaaagagag

SEQ ID NO: 17261 - DNA, 23 bp, Artificial Sequence
  Synthetic
ccgttttttttttttgtcgacgg

SEQ ID NO: 17262 - DNA, 23 bp, Artificial Sequence
  Synthetic
ccgttttttttttttgtcgacgg

SEQ ID NO: 17263 - DNA, 23 bp, Artificial Sequence
  Synthetic
ccgttttttttttttagacaaag

SEQ ID NO: 17264 - DNA, 23 bp, Artificial Sequence
  Synthetic
ccgttttttttttttaattacca

SEQ ID NO: 17265 - DNA, 23 bp, Artificial Sequence
  Synthetic
ccgttttttttttttattgctgg

SEQ ID NO: 17266 - DNA, 23 bp, Artificial Sequence
  Synthetic
ccgttttttttttttactgattt

SEQ ID NO: 17267 - DNA, 23 bp, Artificial Sequence
  Synthetic
ccgttttttttttttcacgagtg

SEQ ID NO: 17268 - DNA, 23 bp, Artificial Sequence
  Synthetic
ccgttttttttttttcaaacgat

SEQ ID NO: 17269 - DNA, 23 bp, Artificial Sequence
  Synthetic
ccgttttttttttttgaaatgaa

SEQ ID NO: 17270 - DNA, 23 bp, Artificial Sequence
  Synthetic
ccgttttttttttttcgcaggct

SEQ ID NO: 17271 - DNA, 23 bp, Artificial Sequence
  Synthetic
ccgttttttttttttcatcaaag

SEQ ID NO: 17272 - DNA, 23 bp, Artificial Sequence
  Synthetic
ccgttttttttttttcctcaaag

SEQ ID NO: 17273 - DNA, 23 bp, Artificial Sequence
  Synthetic
ccgttttttttttttccatcaaa

SEQ ID NO: 17274 - DNA, 23 bp, Artificial Sequence
  Synthetic
ccgttttttttttttgacacact

SEQ ID NO: 17275 - DNA, 23 bp, Artificial Sequence
  Synthetic
ccgttttttttttttcagtttcc

SEQ ID NO: 17276 - DNA, 23 bp, Artificial Sequence
  Synthetic
ccgttttttttttttacatttac

SEQ ID NO: 17277 - DNA, 23 bp, Artificial Sequence
  Synthetic
ccgttttttttttttgagcacct

SEQ ID NO: 17278 - DNA, 23 bp, Artificial Sequence
  Synthetic
ccgttttttttttttgagtcact

SEQ ID NO: 17279 - DNA, 23 bp, Artificial Sequence
  Synthetic
ccgttttttttttttacaggcac

SEQ ID NO: 17280 - DNA, 23 bp, Artificial Sequence
  Synthetic
ccgttttttttttttactcaagg

SEQ ID NO: 17281 - DNA, 23 bp, Artificial Sequence
  Synthetic
ccgttttttttttttacagtata

SEQ ID NO: 17282 - DNA, 23 bp, Artificial Sequence
  Synthetic
ccgttttttttttttgacaaact

SEQ ID NO: 17283 - DNA, 23 bp, Artificial Sequence
  Synthetic
ccgttttttttttttaggccggg

SEQ ID NO: 17284 - DNA, 23 bp, Artificial Sequence
  Synthetic
ccgttttttttttttggccggtg

SEQ ID NO: 17285 - DNA, 23 bp, Artificial Sequence
  Synthetic
ccgttttttttttttggccgtct

SEQ ID NO: 17286 - DNA, 23 bp, Artificial Sequence
  Synthetic
ccgttttttttttttggctgtga

SEQ ID NO: 17287 - DNA, 23 bp, Artificial Sequence
  Synthetic
ccgttttttttttttgaacttat

SEQ ID NO: 17288 - DNA, 23 bp, Artificial Sequence
  Synthetic
ccgttttttttttttctgagcaa

SEQ ID NO: 17289 - DNA, 23 bp, Artificial Sequence
  Synthetic
ccgttttttttttttccagtaag

SEQ ID NO: 17290 - DNA, 23 bp, Artificial Sequence
  Synthetic
ccgttttttttttttggatacca

SEQ ID NO: 17291 - DNA, 23 bp, Artificial Sequence
  Synthetic
ccgttttttttttttgataaaca

SEQ ID NO: 17292 - DNA, 23 bp, Artificial Sequence
  Synthetic
ccgttttttttttttgctatgcc

SEQ ID NO: 17293 - DNA, 23 bp, Artificial Sequence
  Synthetic
ccgttttttttttttgctattcc

SEQ ID NO: 17294 - DNA, 23 bp, Artificial Sequence
  Synthetic
ccgttttttttttttatgcgact

SEQ ID NO: 17295 - DNA, 23 bp, Artificial Sequence
  Synthetic
ccgttttttttttttaccagcta

SEQ ID NO: 17296 - DNA, 23 bp, Artificial Sequence
  Synthetic
ccgttttttttttttatggttgt

SEQ ID NO: 17297 - DNA, 23 bp, Artificial Sequence
  Synthetic
ccgttttttttttttatcacaac

SEQ ID NO: 17298 - DNA, 23 bp, Artificial Sequence
  Synthetic
ccgttttttttttttaaagaaca

SEQ ID NO: 17299 - DNA, 23 bp, Artificial Sequence
  Synthetic
ccgttttttttttttaacaaaat

SEQ ID NO: 17300 - DNA, 23 bp, Artificial Sequence
  Synthetic
ccgttttttttttttctttggta

SEQ ID NO: 17301 - DNA, 23 bp, Artificial Sequence
  Synthetic
ccgttttttttttttcatcttta

SEQ ID NO: 17302 - DNA, 23 bp, Artificial Sequence
  Synthetic
ccgttttttttttttcacctgaa

SEQ ID NO: 17303 - DNA, 23 bp, Artificial Sequence
  Synthetic
ccgttttttttttttggccggga

SEQ ID NO: 17304 - DNA, 23 bp, Artificial Sequence
  Synthetic
ccgttttttttttttaggccggg

SEQ ID NO: 17305 - DNA, 23 bp, Artificial Sequence
  Synthetic
ccgttttttttttttacagctag

SEQ ID NO: 17306 - DNA, 23 bp, Artificial Sequence
  Synthetic
ccgttttttttttttacagctaa

SEQ ID NO: 17307 - DNA, 23 bp, Artificial Sequence
  Synthetic
ccgttttttttttttcagctaga

SEQ ID NO: 17308 - DNA, 23 bp, Artificial Sequence
  Synthetic
ccgttttttttttttcgtatact

SEQ ID NO: 17309 - DNA, 23 bp, Artificial Sequence
  Synthetic
ccgttttttttttttggatacat

SEQ ID NO: 17310 - DNA, 23 bp, Artificial Sequence
  Synthetic
ccgttttttttttttcagctttc

SEQ ID NO: 17311 - DNA, 23 bp, Artificial Sequence
  Synthetic
ccgttttttttttttatacaacc

SEQ ID NO: 17312 - DNA, 23 bp, Artificial Sequence
  Synthetic
ccgttttttttttttcatacttc

SEQ ID NO: 17313 - DNA, 23 bp, Artificial Sequence
  Synthetic
ccgttttttttttttaaattcgg

SEQ ID NO: 17314 - DNA, 23 bp, Artificial Sequence
  Synthetic
ccgttttttttttttcaagttcg

SEQ ID NO: 17315 - DNA, 23 bp, Artificial Sequence
  Synthetic
ccgttttttttttttaagaactc

SEQ ID NO: 17316 - DNA, 23 bp, Artificial Sequence
  Synthetic
ccgttttttttttttcagtacct

SEQ ID NO: 17317 - DNA, 23 bp, Artificial Sequence
  Synthetic
ccgttttttttttttgcattcac

SEQ ID NO: 17318 - DNA, 23 bp, Artificial Sequence
  Synthetic
ccgttttttttttttcaagttag

SEQ ID NO: 17319 - DNA, 23 bp, Artificial Sequence
  Synthetic
ccgttttttttttttagctggtt

SEQ ID NO: 17320 - DNA, 23 bp, Artificial Sequence
  Synthetic
ccgttttttttttttcatcaaaa

SEQ ID NO: 17321 - DNA, 23 bp, Artificial Sequence
  Synthetic
ccgttttttttttttcgtcaaaa

SEQ ID NO: 17322 - DNA, 23 bp, Artificial Sequence
  Synthetic
ccgttttttttttttgagagaga

SEQ ID NO: 17323 - DNA, 23 bp, Artificial Sequence
  Synthetic
ccgttttttttttttccttatca

SEQ ID NO: 17324 - DNA, 23 bp, Artificial Sequence
  Synthetic
ccgttttttttttttccgctgtc

SEQ ID NO: 17325 - DNA, 23 bp, Artificial Sequence
  Synthetic
ccgttttttttttttagaattgc

SEQ ID NO: 17326 - DNA, 23 bp, Artificial Sequence
  Synthetic
ccgttttttttttttaattcttc

SEQ ID NO: 17327 - DNA, 23 bp, Artificial Sequence
  Synthetic
ccgttttttttttttaattctcc

SEQ ID NO: 17328 - DNA, 23 bp, Artificial Sequence
  Synthetic
ccgttttttttttttcccgttag

SEQ ID NO: 17329 - DNA, 23 bp, Artificial Sequence
  Synthetic
ccgttttttttttttcgcgctac

SEQ ID NO: 17330 - DNA, 23 bp, Artificial Sequence
  Synthetic
ccgttttttttttttagcacggt

SEQ ID NO: 17331 - DNA, 23 bp, Artificial Sequence
  Synthetic
ccgttttttttttttagcacggt

SEQ ID NO: 17332 - DNA, 23 bp, Artificial Sequence
  Synthetic
ccgttttttttttttgtaccaga

SEQ ID NO: 17333 - DNA, 23 bp, Artificial Sequence
  Synthetic
ccgttttttttttttacggacga

SEQ ID NO: 17334 - DNA, 23 bp, Artificial Sequence
  Synthetic
ccgttttttttttttgagtgtgg

SEQ ID NO: 17335 - DNA, 23 bp, Artificial Sequence
  Synthetic
ccgttttttttttttatttcata

SEQ ID NO: 17336 - DNA, 23 bp, Artificial Sequence
  Synthetic
ccgttttttttttttaaagagag

SEQ ID NO: 17337 - DNA, 23 bp, Artificial Sequence
  Synthetic
ccgttttttttttttagacaaag

SEQ ID NO: 17338 - DNA, 23 bp, Artificial Sequence
  Synthetic
ccgttttttttttttaattacca

SEQ ID NO: 17339 - DNA, 23 bp, Artificial Sequence
  Synthetic
ccgttttttttttttattgctgg

SEQ ID NO: 17340 - DNA, 23 bp, Artificial Sequence
  Synthetic
ccgttttttttttttactgattt

SEQ ID NO: 17341 - DNA, 23 bp, Artificial Sequence
  Synthetic
ccgttttttttttttcacgagtg

SEQ ID NO: 17342 - DNA, 23 bp, Artificial Sequence
  Synthetic
ccgttttttttttttcaaacgat

SEQ ID NO: 17343 - DNA, 23 bp, Artificial Sequence
  Synthetic
ccgttttttttttttgaaatgaa

SEQ ID NO: 17344 - DNA, 23 bp, Artificial Sequence
  Synthetic
ccgttttttttttttcgcaggct

SEQ ID NO: 17345 - DNA, 23 bp, Artificial Sequence
  Synthetic
ccgttttttttttttcatcaaag

SEQ ID NO: 17346 - DNA, 23 bp, Artificial Sequence
  Synthetic
ccgttttttttttttcctcaaag

SEQ ID NO: 17347 - DNA, 23 bp, Artificial Sequence
  Synthetic
ccgttttttttttttccatcaaa

SEQ ID NO: 17348 - DNA, 23 bp, Artificial Sequence
  Synthetic
ccgttttttttttttgacacact

SEQ ID NO: 17349 - DNA, 23 bp, Artificial Sequence
  Synthetic
ccgttttttttttttacatttac

SEQ ID NO: 17350 - DNA, 23 bp, Artificial Sequence
  Synthetic
ccgttttttttttttgagcacct

SEQ ID NO: 17351 - DNA, 23 bp, Artificial Sequence
  Synthetic
ccgttttttttttttgagtcact

SEQ ID NO: 17352 - DNA, 23 bp, Artificial Sequence
  Synthetic
ccgttttttttttttactcaagg

SEQ ID NO: 17353 - DNA, 23 bp, Artificial Sequence
  Synthetic
ccgttttttttttttacagtata

SEQ ID NO: 17354 - DNA, 23 bp, Artificial Sequence
  Synthetic
ccgttttttttttttgacaaact

SEQ ID NO: 17355 - DNA, 23 bp, Artificial Sequence
  Synthetic
ccgttttttttttttgaacttat

SEQ ID NO: 17356 - DNA, 23 bp, Artificial Sequence
  Synthetic
ccgttttttttttttctgagcaa

SEQ ID NO: 17357 - DNA, 23 bp, Artificial Sequence
  Synthetic
ccgttttttttttttccagtaag

SEQ ID NO: 17358 - DNA, 23 bp, Artificial Sequence
  Synthetic
ccgttttttttttttgataccac

SEQ ID NO: 17359 - DNA, 23 bp, Artificial Sequence
  Synthetic
ccgttttttttttttgataaaca

SEQ ID NO: 17360 - DNA, 23 bp, Artificial Sequence
  Synthetic
ccgttttttttttttgctatgcc

SEQ ID NO: 17361 - DNA, 23 bp, Artificial Sequence
  Synthetic
ccgttttttttttttgctattcc

SEQ ID NO: 17362 - DNA, 23 bp, Artificial Sequence
  Synthetic
ccgttttttttttttatgcgact

SEQ ID NO: 17363 - DNA, 23 bp, Artificial Sequence
  Synthetic
ccgttttttttttttaccagcta

SEQ ID NO: 17364 - DNA, 23 bp, Artificial Sequence
  Synthetic
ccgttttttttttttatggttgt

SEQ ID NO: 17365 - DNA, 23 bp, Artificial Sequence
  Synthetic
ccgttttttttttttatcacaac

SEQ ID NO: 17366 - DNA, 23 bp, Artificial Sequence
  Synthetic
ccgttttttttttttaaagaaca

SEQ ID NO: 17367 - DNA, 23 bp, Artificial Sequence
  Synthetic
ccgttttttttttttaacaaaat

SEQ ID NO: 17368 - DNA, 23 bp, Artificial Sequence
  Synthetic
ccgttttttttttttctttggta

SEQ ID NO: 17369 - DNA, 23 bp, Artificial Sequence
  Synthetic
ccgttttttttttttcatcttta

SEQ ID NO: 17370 - DNA, 23 bp, Artificial Sequence
  Synthetic
ccgttttttttttttcacctgaa

SEQ ID NO: 17371 - DNA, 23 bp, Artificial Sequence
  Synthetic
ccgttttttttttttggccggga

SEQ ID NO: 17372 - DNA, 23 bp, Artificial Sequence
  Synthetic
ccgttttttttttttaggccggg

SEQ ID NO: 17373 - DNA, 23 bp, Artificial Sequence
  Synthetic
ccgttttttttttttacagctag

SEQ ID NO: 17374 - DNA, 23 bp, Artificial Sequence
  Synthetic
ccgttttttttttttacagctaa

SEQ ID NO: 17375 - DNA, 23 bp, Artificial Sequence
  Synthetic
ccgttttttttttttcagctaga

SEQ ID NO: 17376 - DNA, 23 bp, Artificial Sequence
  Synthetic
ccgttttttttttttcgtatact

SEQ ID NO: 17377 - DNA, 23 bp, Artificial Sequence
  Synthetic
ccgttttttttttttggatacat

SEQ ID NO: 17378 - DNA, 23 bp, Artificial Sequence
  Synthetic
ccgttttttttttttctatacaa

SEQ ID NO: 17379 - DNA, 23 bp, Artificial Sequence
  Synthetic
ccgttttttttttttccacacaa

SEQ ID NO: 17380 - DNA, 23 bp, Artificial Sequence
  Synthetic
ccgttttttttttttccatacaa

SEQ ID NO: 17381 - DNA, 23 bp, Artificial Sequence
  Synthetic
ccgttttttttttttccatacaa

SEQ ID NO: 17382 - DNA, 23 bp, Artificial Sequence
  Synthetic
ccgttttttttttttctattcaa

SEQ ID NO: 17383 - DNA, 23 bp, Artificial Sequence
  Synthetic
ccgttttttttttttctatacaa

SEQ ID NO: 17384 - DNA, 23 bp, Artificial Sequence
  Synthetic
ccgttttttttttttctatacaa

SEQ ID NO: 17385 - DNA, 23 bp, Artificial Sequence
  Synthetic
ccgttttttttttttcaacacaa

SEQ ID NO: 17386 - DNA, 23 bp, Artificial Sequence
  Synthetic
ccgttttttttttttcagcacaa

SEQ ID NO: 17387 - DNA, 23 bp, Artificial Sequence
  Synthetic
ccgttttttttttttctgtacaa

SEQ ID NO: 17388 - DNA, 23 bp, Artificial Sequence
  Synthetic
ccgttttttttttttcatacttc

SEQ ID NO: 17389 - DNA, 23 bp, Artificial Sequence
  Synthetic
ccgttttttttttttcaagttcg

SEQ ID NO: 17390 - DNA, 23 bp, Artificial Sequence
  Synthetic
ccgttttttttttttagttatca

SEQ ID NO: 17391 - DNA, 23 bp, Artificial Sequence
  Synthetic
ccgttttttttttttagttatca

SEQ ID NO: 17392 - DNA, 23 bp, Artificial Sequence
  Synthetic
ccgttttttttttttagccctgt

SEQ ID NO: 17393 - DNA, 23 bp, Artificial Sequence
  Synthetic
ccgttttttttttttagccctgt

SEQ ID NO: 17394 - DNA, 23 bp, Artificial Sequence
  Synthetic
ccgttttttttttttaaattcgg

SEQ ID NO: 17395 - DNA, 23 bp, Artificial Sequence
  Synthetic
ccgttttttttttttcccaagac

SEQ ID NO: 17396 - DNA, 23 bp, Artificial Sequence
  Synthetic
ccgttttttttttttcaaattcg

SEQ ID NO: 17397 - DNA, 23 bp, Artificial Sequence
  Synthetic
ccgttttttttttttaaatccgg

SEQ ID NO: 17398 - DNA, 23 bp, Artificial Sequence
  Synthetic
ccgttttttttttttcacattcg

SEQ ID NO: 17399 - DNA, 23 bp, Artificial Sequence
  Synthetic
ccgttttttttttttcccctaaa

SEQ ID NO: 17400 - DNA, 23 bp, Artificial Sequence
  Synthetic
ccgttttttttttttaacaccat

SEQ ID NO: 17401 - DNA, 23 bp, Artificial Sequence
  Synthetic
ccgttttttttttttcattcacc

SEQ ID NO: 17402 - DNA, 23 bp, Artificial Sequence
  Synthetic
ccgttttttttttttcaggttaa

SEQ ID NO: 17403 - DNA, 23 bp, Artificial Sequence
  Synthetic
ccgttttttttttttcaagttag

SEQ ID NO: 17404 - DNA, 23 bp, Artificial Sequence
  Synthetic
ccgttttttttttttcgagttag

SEQ ID NO: 17405 - DNA, 23 bp, Artificial Sequence
  Synthetic
ccgttttttttttttattattac

SEQ ID NO: 17406 - DNA, 23 bp, Artificial Sequence
  Synthetic
ccgttttttttttttcgtaccaa

SEQ ID NO: 17407 - DNA, 23 bp, Artificial Sequence
  Synthetic
ccgttttttttttttaagagacc

SEQ ID NO: 17408 - DNA, 23 bp, Artificial Sequence
  Synthetic
ccgttttttttttttcaagccca

SEQ ID NO: 17409 - DNA, 23 bp, Artificial Sequence
  Synthetic
ccgttttttttttttctttttgg

SEQ ID NO: 17410 - DNA, 23 bp, Artificial Sequence
  Synthetic
ccgttttttttttttccctttta

SEQ ID NO: 17411 - DNA, 23 bp, Artificial Sequence
  Synthetic
ccgttttttttttttccctttca

SEQ ID NO: 17412 - DNA, 23 bp, Artificial Sequence
  Synthetic
ccgttttttttttttccctttta

SEQ ID NO: 17413 - DNA, 23 bp, Artificial Sequence
  Synthetic
ccgttttttttttttaccatggc

SEQ ID NO: 17414 - DNA, 23 bp, Artificial Sequence
  Synthetic
ccgttttttttttttaacaatct

SEQ ID NO: 17415 - DNA, 23 bp, Artificial Sequence
  Synthetic
ccgttttttttttttgctggttg

SEQ ID NO: 17416 - DNA, 23 bp, Artificial Sequence
  Synthetic
ccgttttttttttttgttccatt

SEQ ID NO: 17417 - DNA, 23 bp, Artificial Sequence
  Synthetic
ccgttttttttttttctggttga

SEQ ID NO: 17418 - DNA, 23 bp, Artificial Sequence
  Synthetic
ccgttttttttttttcttggttc

SEQ ID NO: 17419 - DNA, 23 bp, Artificial Sequence
  Synthetic
ccgttttttttttttctggttga

SEQ ID NO: 17420 - DNA, 23 bp, Artificial Sequence
  Synthetic
ccgttttttttttttcataggaa

SEQ ID NO: 17421 - DNA, 23 bp, Artificial Sequence
  Synthetic
ccgttttttttttttgataggaa

SEQ ID NO: 17422 - DNA, 23 bp, Artificial Sequence
  Synthetic
ccgttttttttttttcataggaa

SEQ ID NO: 17423 - DNA, 23 bp, Artificial Sequence
  Synthetic
ccgttttttttttttgcgtattc

SEQ ID NO: 17424 - DNA, 23 bp, Artificial Sequence
  Synthetic
ccgttttttttttttcctgattc

SEQ ID NO: 17425 - DNA, 23 bp, Artificial Sequence
  Synthetic
ccgttttttttttttacacatgc

SEQ ID NO: 17426 - DNA, 23 bp, Artificial Sequence
  Synthetic
ccgttttttttttttccataggg

SEQ ID NO: 17427 - DNA, 23 bp, Artificial Sequence
  Synthetic
ccgttttttttttttcgtggttc

SEQ ID NO: 17428 - DNA, 23 bp, Artificial Sequence
  Synthetic
ccgttttttttttttatcgttac

SEQ ID NO: 17429 - DNA, 23 bp, Artificial Sequence
  Synthetic
ccgttttttttttttataaagta

SEQ ID NO: 17430 - DNA, 23 bp, Artificial Sequence
  Synthetic
ccgttttttttttttagtgcttt

SEQ ID NO: 17431 - DNA, 23 bp, Artificial Sequence
  Synthetic
ccgttttttttttttagtgctgt

SEQ ID NO: 17432 - DNA, 23 bp, Artificial Sequence
  Synthetic
ccgttttttttttttgctacagt

SEQ ID NO: 17433 - DNA, 23 bp, Artificial Sequence
  Synthetic
ccgttttttttttttacatcatc

SEQ ID NO: 17434 - DNA, 23 bp, Artificial Sequence
  Synthetic
ccgttttttttttttgattcctg

SEQ ID NO: 17435 - DNA, 23 bp, Artificial Sequence
  Synthetic
ccgttttttttttttatctatgg

SEQ ID NO: 17436 - DNA, 23 bp, Artificial Sequence
  Synthetic
ccgttttttttttttcccttgga

SEQ ID NO: 17437 - DNA, 23 bp, Artificial Sequence
  Synthetic
ccgttttttttttttaaagttct

SEQ ID NO: 17438 - DNA, 23 bp, Artificial Sequence
  Synthetic
ccgttttttttttttctggtaca

SEQ ID NO: 17439 - DNA, 23 bp, Artificial Sequence
  Synthetic
ccgttttttttttttaaagttct

SEQ ID NO: 17440 - DNA, 23 bp, Artificial Sequence
  Synthetic
ccgttttttttttttcacttttg

SEQ ID NO: 17441 - DNA, 23 bp, Artificial Sequence
  Synthetic
ccgttttttttttttcatttttg

SEQ ID NO: 17442 - DNA, 23 bp, Artificial Sequence
  Synthetic
ccgttttttttttttcatttttg

SEQ ID NO: 17443 - DNA, 23 bp, Artificial Sequence
  Synthetic
ccgttttttttttttcctatcac

SEQ ID NO: 17444 - DNA, 23 bp, Artificial Sequence
  Synthetic
ccgttttttttttttcaaaccat

SEQ ID NO: 17445 - DNA, 23 bp, Artificial Sequence
  Synthetic
ccgttttttttttttcgcagcac

SEQ ID NO: 17446 - DNA, 23 bp, Artificial Sequence
  Synthetic
ccgttttttttttttaaaccatg

SEQ ID NO: 17447 - DNA, 23 bp, Artificial Sequence
  Synthetic
ccgttttttttttttaaaccatg

SEQ ID NO: 17448 - DNA, 23 bp, Artificial Sequence
  Synthetic
ccgttttttttttttccaatatt

SEQ ID NO: 17449 - DNA, 23 bp, Artificial Sequence
  Synthetic
ccgttttttttttttcaatattt

SEQ ID NO: 17450 - DNA, 23 bp, Artificial Sequence
  Synthetic
ccgttttttttttttcaatattt

SEQ ID NO: 17451 - DNA, 23 bp, Artificial Sequence
  Synthetic
ccgttttttttttttctgcactg

SEQ ID NO: 17452 - DNA, 23 bp, Artificial Sequence
  Synthetic
ccgttttttttttttgaagtgcc

SEQ ID NO: 17453 - DNA, 23 bp, Artificial Sequence
  Synthetic
ccgttttttttttttcaccgaca

SEQ ID NO: 17454 - DNA, 23 bp, Artificial Sequence
  Synthetic
ccgttttttttttttacaatcaa

SEQ ID NO: 17455 - DNA, 23 bp, Artificial Sequence
  Synthetic
ccgttttttttttttcaccgaca

SEQ ID NO: 17456 - DNA, 23 bp, Artificial Sequence
  Synthetic
ccgttttttttttttcaccgaca

SEQ ID NO: 17457 - DNA, 23 bp, Artificial Sequence
  Synthetic
ccgttttttttttttagttctac

SEQ ID NO: 17458 - DNA, 23 bp, Artificial Sequence
  Synthetic
ccgttttttttttttggcaagtc

SEQ ID NO: 17459 - DNA, 23 bp, Artificial Sequence
  Synthetic
ccgttttttttttttgtgaattc

SEQ ID NO: 17460 - DNA, 23 bp, Artificial Sequence
  Synthetic
ccgttttttttttttccttatca

SEQ ID NO: 17461 - DNA, 23 bp, Artificial Sequence
  Synthetic
ccgttttttttttttctgcaaca

SEQ ID NO: 17462 - DNA, 23 bp, Artificial Sequence
  Synthetic
ccgttttttttttttgcactaga

SEQ ID NO: 17463 - DNA, 23 bp, Artificial Sequence
  Synthetic
ccgttttttttttttgcactaaa

SEQ ID NO: 17464 - DNA, 23 bp, Artificial Sequence
  Synthetic
ccgttttttttttttagaagggg

SEQ ID NO: 17465 - DNA, 23 bp, Artificial Sequence
  Synthetic
ccgttttttttttttctacacaa

SEQ ID NO: 17466 - DNA, 23 bp, Artificial Sequence
  Synthetic
ccgttttttttttttctaatata

SEQ ID NO: 17467 - DNA, 23 bp, Artificial Sequence
  Synthetic
ccgttttttttttttaccgaata

SEQ ID NO: 17468 - DNA, 23 bp, Artificial Sequence
  Synthetic
ccgttttttttttttctgtcaat

SEQ ID NO: 17469 - DNA, 23 bp, Artificial Sequence
  Synthetic
ccgttttttttttttgggacttt

SEQ ID NO: 17470 - DNA, 23 bp, Artificial Sequence
  Synthetic
ccgttttttttttttcgggactt

SEQ ID NO: 17471 - DNA, 23 bp, Artificial Sequence
  Synthetic
ccgttttttttttttacatggag

SEQ ID NO: 17472 - DNA, 23 bp, Artificial Sequence
  Synthetic
ccgttttttttttttacatggag

SEQ ID NO: 17473 - DNA, 23 bp, Artificial Sequence
  Synthetic
ccgttttttttttttcaacaaca

SEQ ID NO: 17474 - DNA, 23 bp, Artificial Sequence
  Synthetic
ccgttttttttttttcaacaact

SEQ ID NO: 17475 - DNA, 23 bp, Artificial Sequence
  Synthetic
ccgttttttttttttacaggtag

SEQ ID NO: 17476 - DNA, 23 bp, Artificial Sequence
  Synthetic
ccgttttttttttttccaatgtg

SEQ ID NO: 17477 - DNA, 23 bp, Artificial Sequence
  Synthetic
ccgttttttttttttgttttgca

SEQ ID NO: 17478 - DNA, 23 bp, Artificial Sequence
  Synthetic
ccgttttttttttttgcaactat

SEQ ID NO: 17479 - DNA, 23 bp, Artificial Sequence
  Synthetic
ccgttttttttttttgttttgca

SEQ ID NO: 17480 - DNA, 23 bp, Artificial Sequence
  Synthetic
ccgttttttttttttaatgcaaa

SEQ ID NO: 17481 - DNA, 23 bp, Artificial Sequence
  Synthetic
ccgttttttttttttagttttgc

SEQ ID NO: 17482 - DNA, 23 bp, Artificial Sequence
  Synthetic
ccgttttttttttttgttttgca

SEQ ID NO: 17483 - DNA, 23 bp, Artificial Sequence
  Synthetic
ccgttttttttttttatcgttac

SEQ ID NO: 17484 - DNA, 23 bp, Artificial Sequence
  Synthetic
ccgttttttttttttcattacca

SEQ ID NO: 17485 - DNA, 23 bp, Artificial Sequence
  Synthetic
ccgttttttttttttatcattac

SEQ ID NO: 17486 - DNA, 23 bp, Artificial Sequence
  Synthetic
ccgttttttttttttcatgccct

SEQ ID NO: 17487 - DNA, 23 bp, Artificial Sequence
  Synthetic
ccgttttttttttttaagaggta

SEQ ID NO: 17488 - DNA, 23 bp, Artificial Sequence
  Synthetic
ccgttttttttttttagtggtcc

SEQ ID NO: 17489 - DNA, 23 bp, Artificial Sequence
  Synthetic
ccgttttttttttttagtggtcc

SEQ ID NO: 17490 - DNA, 23 bp, Artificial Sequence
  Synthetic
ccgttttttttttttaactgttg

SEQ ID NO: 17491 - DNA, 23 bp, Artificial Sequence
  Synthetic
ccgttttttttttttgcatagga

SEQ ID NO: 17492 - DNA, 23 bp, Artificial Sequence
  Synthetic
ccgttttttttttttgactccgg

SEQ ID NO: 17493 - DNA, 23 bp, Artificial Sequence
  Synthetic
ccgttttttttttttacacactt

SEQ ID NO: 17494 - DNA, 23 bp, Artificial Sequence
  Synthetic
ccgttttttttttttcctgcact

SEQ ID NO: 17495 - DNA, 23 bp, Artificial Sequence
  Synthetic
ccgttttttttttttaagtgctc

SEQ ID NO: 17496 - DNA, 23 bp, Artificial Sequence
  Synthetic
ccgttttttttttttcctgcact

SEQ ID NO: 17497 - DNA, 23 bp, Artificial Sequence
  Synthetic
ccgttttttttttttcaacacca

SEQ ID NO: 17498 - DNA, 23 bp, Artificial Sequence
  Synthetic
ccgttttttttttttccgctgtc

SEQ ID NO: 17499 - DNA, 23 bp, Artificial Sequence
  Synthetic
ccgttttttttttttatgtgcgt

SEQ ID NO: 17500 - DNA, 23 bp, Artificial Sequence
  Synthetic
ccgttttttttttttccatgact

SEQ ID NO: 17501 - DNA, 23 bp, Artificial Sequence
  Synthetic
ccgttttttttttttcctgtctg

SEQ ID NO: 17502 - DNA, 23 bp, Artificial Sequence
  Synthetic
ccgttttttttttttcagttgcc

SEQ ID NO: 17503 - DNA, 23 bp, Artificial Sequence
  Synthetic
ccgttttttttttttcagttgcc

SEQ ID NO: 17504 - DNA, 23 bp, Artificial Sequence
  Synthetic
ccgttttttttttttaatcagtt

SEQ ID NO: 17505 - DNA, 23 bp, Artificial Sequence
  Synthetic
ccgttttttttttttcatggtta

SEQ ID NO: 17506 - DNA, 23 bp, Artificial Sequence
  Synthetic
ccgttttttttttttatggttag

SEQ ID NO: 17507 - DNA, 23 bp, Artificial Sequence
  Synthetic
ccgttttttttttttgaattgcg

SEQ ID NO: 17508 - DNA, 23 bp, Artificial Sequence
  Synthetic
ccgttttttttttttgtgtccga

SEQ ID NO: 17509 - DNA, 23 bp, Artificial Sequence
  Synthetic
ccgttttttttttttaacccagc

SEQ ID NO: 17510 - DNA, 23 bp, Artificial Sequence
  Synthetic
ccgttttttttttttgacccagt

SEQ ID NO: 17511 - DNA, 23 bp, Artificial Sequence
  Synthetic
ccgttttttttttttggtatttg

SEQ ID NO: 17512 - DNA, 23 bp, Artificial Sequence
  Synthetic
ccgttttttttttttagttcttc

SEQ ID NO: 17513 - DNA, 23 bp, Artificial Sequence
  Synthetic
ccgttttttttttttagctcttc

SEQ ID NO: 17514 - DNA, 23 bp, Artificial Sequence
  Synthetic
ccgttttttttttttaaatccct

SEQ ID NO: 17515 - DNA, 23 bp, Artificial Sequence
  Synthetic
ccgttttttttttttaatccctg

SEQ ID NO: 17516 - DNA, 23 bp, Artificial Sequence
  Synthetic
ccgttttttttttttcctgctga

SEQ ID NO: 17517 - DNA, 23 bp, Artificial Sequence
  Synthetic
ccgttttttttttttgaccgaga

SEQ ID NO: 17518 - DNA, 23 bp, Artificial Sequence
  Synthetic
ccgttttttttttttcctatcct

SEQ ID NO: 17519 - DNA, 23 bp, Artificial Sequence
  Synthetic
ccgttttttttttttcctatcct

SEQ ID NO: 17520 - DNA, 23 bp, Artificial Sequence
  Synthetic
ccgttttttttttttcggaactt

SEQ ID NO: 17521 - DNA, 23 bp, Artificial Sequence
  Synthetic
ccgttttttttttttagaactta

SEQ ID NO: 17522 - DNA, 23 bp, Artificial Sequence
  Synthetic
ccgttttttttttttagaactta

SEQ ID NO: 17523 - DNA, 23 bp, Artificial Sequence
  Synthetic
ccgttttttttttttgttcacaa

SEQ ID NO: 17524 - DNA, 23 bp, Artificial Sequence
  Synthetic
ccgttttttttttttagaactta

SEQ ID NO: 17525 - DNA, 23 bp, Artificial Sequence
  Synthetic
ccgttttttttttttctgaactt

SEQ ID NO: 17526 - DNA, 23 bp, Artificial Sequence
  Synthetic
ccgttttttttttttccgatttc

SEQ ID NO: 17527 - DNA, 23 bp, Artificial Sequence
  Synthetic
ccgttttttttttttactgattt

SEQ ID NO: 17528 - DNA, 23 bp, Artificial Sequence
  Synthetic
ccgttttttttttttacaatact

SEQ ID NO: 17529 - DNA, 23 bp, Artificial Sequence
  Synthetic
ccgttttttttttttatgacaat

SEQ ID NO: 17530 - DNA, 23 bp, Artificial Sequence
  Synthetic
ccgttttttttttttgacaatac

SEQ ID NO: 17531 - DNA, 23 bp, Artificial Sequence
  Synthetic
ccgttttttttttttcagtcggg

SEQ ID NO: 17532 - DNA, 23 bp, Artificial Sequence
  Synthetic
ccgttttttttttttctgagtgt

SEQ ID NO: 17533 - DNA, 23 bp, Artificial Sequence
  Synthetic
ccgttttttttttttagagtgta

SEQ ID NO: 17534 - DNA, 23 bp, Artificial Sequence
  Synthetic
ccgttttttttttttcagtcggg

SEQ ID NO: 17535 - DNA, 23 bp, Artificial Sequence
  Synthetic
ccgttttttttttttcagtcaag

SEQ ID NO: 17536 - DNA, 23 bp, Artificial Sequence
  Synthetic
ccgttttttttttttgcaaacat

SEQ ID NO: 17537 - DNA, 23 bp, Artificial Sequence
  Synthetic
ccgttttttttttttgctatgcc

SEQ ID NO: 17538 - DNA, 23 bp, Artificial Sequence
  Synthetic
ccgttttttttttttacaaaatc

SEQ ID NO: 17539 - DNA, 23 bp, Artificial Sequence
  Synthetic
ccgttttttttttttaaccagct

SEQ ID NO: 17540 - DNA, 23 bp, Artificial Sequence
  Synthetic
ccgttttttttttttatcagcta

SEQ ID NO: 17541 - DNA, 23 bp, Artificial Sequence
  Synthetic
ccgttttttttttttatcaacta

SEQ ID NO: 17542 - DNA, 23 bp, Artificial Sequence
  Synthetic
ccgttttttttttttagatggat

SEQ ID NO: 17543 - DNA, 23 bp, Artificial Sequence
  Synthetic
ccgttttttttttttaggatttt

SEQ ID NO: 17544 - DNA, 23 bp, Artificial Sequence
  Synthetic
ccgttttttttttttcgcgagcc

SEQ ID NO: 17545 - DNA, 23 bp, Artificial Sequence
  Synthetic
ccgttttttttttttggcattac

SEQ ID NO: 17546 - DNA, 23 bp, Artificial Sequence
  Synthetic
ccgttttttttttttccccaaca

SEQ ID NO: 17547 - DNA, 23 bp, Artificial Sequence
  Synthetic
ccgttttttttttttccccaact

SEQ ID NO: 17548 - DNA, 23 bp, Artificial Sequence
  Synthetic
ccgttttttttttttccccaaag

SEQ ID NO: 17549 - DNA, 23 bp, Artificial Sequence
  Synthetic
ccgttttttttttttcgccaaca

SEQ ID NO: 17550 - DNA, 23 bp, Artificial Sequence
  Synthetic
ccgttttttttttttcccaattt

SEQ ID NO: 17551 - DNA, 23 bp, Artificial Sequence
  Synthetic
ccgttttttttttttctcagtaa

SEQ ID NO: 17552 - DNA, 23 bp, Artificial Sequence
  Synthetic
ccgttttttttttttctattagc

SEQ ID NO: 17553 - DNA, 23 bp, Artificial Sequence
  Synthetic
ccgttttttttttttctataagc

SEQ ID NO: 17554 - DNA, 23 bp, Artificial Sequence
  Synthetic
ccgttttttttttttatgtagtc

SEQ ID NO: 17555 - DNA, 23 bp, Artificial Sequence
  Synthetic
ccgttttttttttttcaaccatc

SEQ ID NO: 17556 - DNA, 23 bp, Artificial Sequence
  Synthetic
ccgttttttttttttcaatattg

SEQ ID NO: 17557 - DNA, 23 bp, Artificial Sequence
  Synthetic
ccgttttttttttttcagtattt

SEQ ID NO: 17558 - DNA, 23 bp, Artificial Sequence
  Synthetic
ccgttttttttttttagtaccat

SEQ ID NO: 17559 - DNA, 23 bp, Artificial Sequence
  Synthetic
ccgttttttttttttggatgaat

SEQ ID NO: 17560 - DNA, 23 bp, Artificial Sequence
  Synthetic
ccgttttttttttttccagtaac

SEQ ID NO: 17561 - DNA, 23 bp, Artificial Sequence
  Synthetic
ccgttttttttttttccacattg

SEQ ID NO: 17562 - DNA, 23 bp, Artificial Sequence
  Synthetic
ccgttttttttttttcacagtgt

SEQ ID NO: 17563 - DNA, 23 bp, Artificial Sequence
  Synthetic
ccgttttttttttttcatttagc

SEQ ID NO: 17564 - DNA, 23 bp, Artificial Sequence
  Synthetic
ccgttttttttttttctgcatta

SEQ ID NO: 17565 - DNA, 23 bp, Artificial Sequence
  Synthetic
ccgttttttttttttagccgtac

SEQ ID NO: 17566 - DNA, 23 bp, Artificial Sequence
  Synthetic
ccgttttttttttttacatcact

SEQ ID NO: 17567 - DNA, 23 bp, Artificial Sequence
  Synthetic
ccgttttttttttttctgaaacg

SEQ ID NO: 17568 - DNA, 23 bp, Artificial Sequence
  Synthetic
ccgttttttttttttcacagatt

SEQ ID NO: 17569 - DNA, 23 bp, Artificial Sequence
  Synthetic
ccgttttttttttttagtaacat

SEQ ID NO: 17570 - DNA, 23 bp, Artificial Sequence
  Synthetic
ccgttttttttttttcagtcgca

SEQ ID NO: 17571 - DNA, 23 bp, Artificial Sequence
  Synthetic
ccgttttttttttttactagaaa

SEQ ID NO: 17572 - DNA, 23 bp, Artificial Sequence
  Synthetic
ccgttttttttttttgagttctg

SEQ ID NO: 17573 - DNA, 23 bp, Artificial Sequence
  Synthetic
ccgttttttttttttgtcttcaa

SEQ ID NO: 17574 - DNA, 23 bp, Artificial Sequence
  Synthetic
ccgttttttttttttgggaggaa

SEQ ID NO: 17575 - DNA, 23 bp, Artificial Sequence
  Synthetic
ccgttttttttttttaaacgtag

SEQ ID NO: 17576 - DNA, 23 bp, Artificial Sequence
  Synthetic
ccgttttttttttttcccaggtc

SEQ ID NO: 17577 - DNA, 23 bp, Artificial Sequence
  Synthetic
ccgttttttttttttacacagca

SEQ ID NO: 17578 - DNA, 23 bp, Artificial Sequence
  Synthetic
ccgttttttttttttatccggga

SEQ ID NO: 17579 - DNA, 23 bp, Artificial Sequence
  Synthetic
ccgttttttttttttcgagagtt

SEQ ID NO: 17580 - DNA, 23 bp, Artificial Sequence
  Synthetic
ccgttttttttttttccactgag

SEQ ID NO: 17581 - DNA, 23 bp, Artificial Sequence
  Synthetic
ccgttttttttttttgtacgatt

SEQ ID NO: 17582 - DNA, 23 bp, Artificial Sequence
  Synthetic
ccgttttttttttttaagtttag

SEQ ID NO: 17583 - DNA, 23 bp, Artificial Sequence
  Synthetic
ccgttttttttttttaacttttt

SEQ ID NO: 17584 - DNA, 23 bp, Artificial Sequence
  Synthetic
ccgttttttttttttaggttttg

SEQ ID NO: 17585 - DNA, 23 bp, Artificial Sequence
  Synthetic
ccgttttttttttttggtcccga

SEQ ID NO: 17586 - DNA, 23 bp, Artificial Sequence
  Synthetic
ccgttttttttttttcccttctc

SEQ ID NO: 17587 - DNA, 23 bp, Artificial Sequence
  Synthetic
ccgttttttttttttgtaccata

SEQ ID NO: 17588 - DNA, 23 bp, Artificial Sequence
  Synthetic
ccgttttttttttttaacaaaat

SEQ ID NO: 17589 - DNA, 23 bp, Artificial Sequence
  Synthetic
ccgttttttttttttcaaaatca

SEQ ID NO: 17590 - DNA, 23 bp, Artificial Sequence
  Synthetic
ccgttttttttttttacagctag

SEQ ID NO: 17591 - DNA, 23 bp, Artificial Sequence
  Synthetic
ccgttttttttttttcggttatc

SEQ ID NO: 17592 - DNA, 23 bp, Artificial Sequence
  Synthetic
ccgttttttttttttaggccggg

SEQ ID NO: 17593 - DNA, 23 bp, Artificial Sequence
  Synthetic
ccgttttttttttttaggccggg

SEQ ID NO: 17594 - DNA, 23 bp, Artificial Sequence
  Synthetic
ccgttttttttttttctgcacaa

SEQ ID NO: 17595 - DNA, 23 bp, Artificial Sequence
  Synthetic
ccgttttttttttttcaaaaatg

SEQ ID NO: 17596 - DNA, 23 bp, Artificial Sequence
  Synthetic
ccgttttttttttttcaagatcg

SEQ ID NO: 17597 - DNA, 23 bp, Artificial Sequence
  Synthetic
ccgttttttttttttacatagtg

SEQ ID NO: 17598 - DNA, 23 bp, Artificial Sequence
  Synthetic
ccgttttttttttttagcacgtc

SEQ ID NO: 17599 - DNA, 23 bp, Artificial Sequence
  Synthetic
ccgttttttttttttagccaact

SEQ ID NO: 17600 - DNA, 23 bp, Artificial Sequence
  Synthetic
ccgttttttttttttcagtcagc

SEQ ID NO: 17601 - DNA, 23 bp, Artificial Sequence
  Synthetic
ccgttttttttttttaactagcg

SEQ ID NO: 17602 - DNA, 23 bp, Artificial Sequence
  Synthetic
ccgttttttttttttaccacacc

SEQ ID NO: 17603 - DNA, 23 bp, Artificial Sequence
  Synthetic
ccgttttttttttttgccgtccc

SEQ ID NO: 17604 - DNA, 23 bp, Artificial Sequence
  Synthetic
ccgttttttttttttcctactac

SEQ ID NO: 17605 - DNA, 23 bp, Artificial Sequence
  Synthetic
ccgttttttttttttaatcggca

SEQ ID NO: 17606 - DNA, 23 bp, Artificial Sequence
  Synthetic
ccgttttttttttttcaaggaaa

SEQ ID NO: 17607 - DNA, 23 bp, Artificial Sequence
  Synthetic
ccgttttttttttttagagcaca

SEQ ID NO: 17608 - DNA, 23 bp, Artificial Sequence
  Synthetic
ccgttttttttttttggggacac

SEQ ID NO: 17609 - DNA, 23 bp, Artificial Sequence
  Synthetic
ccgttttttttttttgtatgcct

SEQ ID NO: 17610 - DNA, 23 bp, Artificial Sequence
  Synthetic
ccgttttttttttttataggaag

SEQ ID NO: 17611 - DNA, 23 bp, Artificial Sequence
  Synthetic
ccgttttttttttttattcccaa

SEQ ID NO: 17612 - DNA, 23 bp, Artificial Sequence
  Synthetic
ccgttttttttttttaagggcga

SEQ ID NO: 17613 - DNA, 23 bp, Artificial Sequence
  Synthetic
ccgttttttttttttaacaggct

SEQ ID NO: 17614 - DNA, 23 bp, Artificial Sequence
  Synthetic
ccgttttttttttttaatgaaga

SEQ ID NO: 17615 - DNA, 23 bp, Artificial Sequence
  Synthetic
ccgttttttttttttacctggtg

SEQ ID NO: 17616 - DNA, 23 bp, Artificial Sequence
  Synthetic
ccgttttttttttttcacaacac

SEQ ID NO: 17617 - DNA, 23 bp, Artificial Sequence
  Synthetic
ccgttttttttttttcacaccag

SEQ ID NO: 17618 - DNA, 23 bp, Artificial Sequence
  Synthetic
ccgttttttttttttatgggcag

SEQ ID NO: 17619 - DNA, 23 bp, Artificial Sequence
  Synthetic
ccgttttttttttttaggctagt

SEQ ID NO: 17620 - DNA, 23 bp, Artificial Sequence
  Synthetic
ccgttttttttttttgcctatgg

SEQ ID NO: 17621 - DNA, 23 bp, Artificial Sequence
  Synthetic
ccgttttttttttttctggacac

SEQ ID NO: 17622 - DNA, 23 bp, Artificial Sequence
  Synthetic
ccgttttttttttttcgacccca

SEQ ID NO: 17623 - DNA, 23 bp, Artificial Sequence
  Synthetic
ccgttttttttttttacaatcta

SEQ ID NO: 17624 - DNA, 23 bp, Artificial Sequence
  Synthetic
ccgttttttttttttcgggaccc

SEQ ID NO: 17625 - DNA, 23 bp, Artificial Sequence
  Synthetic
ccgttttttttttttctccgggg

SEQ ID NO: 17626 - DNA, 23 bp, Artificial Sequence
  Synthetic
ccgttttttttttttatttctgc

SEQ ID NO: 17627 - DNA, 23 bp, Artificial Sequence
  Synthetic
ccgttttttttttttatctgctg

SEQ ID NO: 17628 - DNA, 23 bp, Artificial Sequence
  Synthetic
ccgttttttttttttgcttacac

SEQ ID NO: 17629 - DNA, 23 bp, Artificial Sequence
  Synthetic
ccgttttttttttttctatacaa

SEQ ID NO: 17630 - DNA, 23 bp, Artificial Sequence
  Synthetic
ccgttttttttttttccacacaa

SEQ ID NO: 17631 - DNA, 23 bp, Artificial Sequence
  Synthetic
ccgttttttttttttccatacaa

SEQ ID NO: 17632 - DNA, 23 bp, Artificial Sequence
  Synthetic
ccgttttttttttttctattcaa

SEQ ID NO: 17633 - DNA, 23 bp, Artificial Sequence
  Synthetic
ccgttttttttttttctatacaa

SEQ ID NO: 17634 - DNA, 23 bp, Artificial Sequence
  Synthetic
ccgttttttttttttcaacacaa

SEQ ID NO: 17635 - DNA, 23 bp, Artificial Sequence
  Synthetic
ccgttttttttttttcagcacaa

SEQ ID NO: 17636 - DNA, 23 bp, Artificial Sequence
  Synthetic
ccgttttttttttttctgtacaa

SEQ ID NO: 17637 - DNA, 23 bp, Artificial Sequence
  Synthetic
ccgttttttttttttcatacttc

SEQ ID NO: 17638 - DNA, 23 bp, Artificial Sequence
  Synthetic
ccgttttttttttttcaagttcg

SEQ ID NO: 17639 - DNA, 23 bp, Artificial Sequence
  Synthetic
ccgttttttttttttagttatca

SEQ ID NO: 17640 - DNA, 23 bp, Artificial Sequence
  Synthetic
ccgttttttttttttagttatca

SEQ ID NO: 17641 - DNA, 23 bp, Artificial Sequence
  Synthetic
ccgttttttttttttagccctgt

SEQ ID NO: 17642 - DNA, 23 bp, Artificial Sequence
  Synthetic
ccgttttttttttttagccctgt

SEQ ID NO: 17643 - DNA, 23 bp, Artificial Sequence
  Synthetic
ccgttttttttttttcaaattcg

SEQ ID NO: 17644 - DNA, 23 bp, Artificial Sequence
  Synthetic
ccgttttttttttttaaatccgg

SEQ ID NO: 17645 - DNA, 23 bp, Artificial Sequence
  Synthetic
ccgttttttttttttcacacatt

SEQ ID NO: 17646 - DNA, 23 bp, Artificial Sequence
  Synthetic
ccgttttttttttttaacaccat

SEQ ID NO: 17647 - DNA, 23 bp, Artificial Sequence
  Synthetic
ccgttttttttttttcattcacc

SEQ ID NO: 17648 - DNA, 23 bp, Artificial Sequence
  Synthetic
ccgttttttttttttcaggttaa

SEQ ID NO: 17649 - DNA, 23 bp, Artificial Sequence
  Synthetic
ccgttttttttttttcaagttag

SEQ ID NO: 17650 - DNA, 23 bp, Artificial Sequence
  Synthetic
ccgttttttttttttattattac

SEQ ID NO: 17651 - DNA, 23 bp, Artificial Sequence
  Synthetic
ccgttttttttttttaagagacc

SEQ ID NO: 17652 - DNA, 23 bp, Artificial Sequence
  Synthetic
ccgttttttttttttcaagccca

SEQ ID NO: 17653 - DNA, 23 bp, Artificial Sequence
  Synthetic
ccgttttttttttttccctttta

SEQ ID NO: 17654 - DNA, 23 bp, Artificial Sequence
  Synthetic
ccgttttttttttttaccatggc

SEQ ID NO: 17655 - DNA, 23 bp, Artificial Sequence
  Synthetic
ccgttttttttttttgctggttg

SEQ ID NO: 17656 - DNA, 23 bp, Artificial Sequence
  Synthetic
ccgttttttttttttcataggaa

SEQ ID NO: 17657 - DNA, 23 bp, Artificial Sequence
  Synthetic
ccgttttttttttttgataggaa

SEQ ID NO: 17658 - DNA, 23 bp, Artificial Sequence
  Synthetic
ccgttttttttttttgcgtattc

SEQ ID NO: 17659 - DNA, 23 bp, Artificial Sequence
  Synthetic
ccgttttttttttttcctgattc

SEQ ID NO: 17660 - DNA, 23 bp, Artificial Sequence
  Synthetic
ccgttttttttttttccataggg

SEQ ID NO: 17661 - DNA, 23 bp, Artificial Sequence
  Synthetic
ccgttttttttttttagtgcttt

SEQ ID NO: 17662 - DNA, 23 bp, Artificial Sequence
  Synthetic
ccgttttttttttttagtgcttt

SEQ ID NO: 17663 - DNA, 23 bp, Artificial Sequence
  Synthetic
ccgttttttttttttacatcatc

SEQ ID NO: 17664 - DNA, 23 bp, Artificial Sequence
  Synthetic
ccgttttttttttttaaagttct

SEQ ID NO: 17665 - DNA, 23 bp, Artificial Sequence
  Synthetic
ccgttttttttttttaaagttct

SEQ ID NO: 17666 - DNA, 23 bp, Artificial Sequence
  Synthetic
ccgttttttttttttcacttttg

SEQ ID NO: 17667 - DNA, 23 bp, Artificial Sequence
  Synthetic
ccgttttttttttttcatttttg

SEQ ID NO: 17668 - DNA, 23 bp, Artificial Sequence
  Synthetic
ccgttttttttttttcaaaccat

SEQ ID NO: 17669 - DNA, 23 bp, Artificial Sequence
  Synthetic
ccgttttttttttttaaaccatg

SEQ ID NO: 17670 - DNA, 23 bp, Artificial Sequence
  Synthetic
ccgttttttttttttcaatattt

SEQ ID NO: 17671 - DNA, 23 bp, Artificial Sequence
  Synthetic
ccgttttttttttttctgcactg

SEQ ID NO: 17672 - DNA, 23 bp, Artificial Sequence
  Synthetic
ccgttttttttttttgcactaga

SEQ ID NO: 17673 - DNA, 23 bp, Artificial Sequence
  Synthetic
ccgttttttttttttcaccgaca

SEQ ID NO: 17674 - DNA, 23 bp, Artificial Sequence
  Synthetic
ccgttttttttttttacaatcaa

SEQ ID NO: 17675 - DNA, 23 bp, Artificial Sequence
  Synthetic
ccgttttttttttttcaccgaca

SEQ ID NO: 17676 - DNA, 23 bp, Artificial Sequence
  Synthetic
ccgttttttttttttggcaagtc

SEQ ID NO: 17677 - DNA, 23 bp, Artificial Sequence
  Synthetic
ccgttttttttttttgtgaattc

SEQ ID NO: 17678 - DNA, 23 bp, Artificial Sequence
  Synthetic
ccgttttttttttttcttatcag

SEQ ID NO: 17679 - DNA, 23 bp, Artificial Sequence
  Synthetic
ccgttttttttttttctgcaaca

SEQ ID NO: 17680 - DNA, 23 bp, Artificial Sequence
  Synthetic
ccgttttttttttttgataccag

SEQ ID NO: 17681 - DNA, 23 bp, Artificial Sequence
  Synthetic
ccgttttttttttttctaatata

SEQ ID NO: 17682 - DNA, 23 bp, Artificial Sequence
  Synthetic
ccgttttttttttttctgtcaat

SEQ ID NO: 17683 - DNA, 23 bp, Artificial Sequence
  Synthetic
ccgttttttttttttgggacttt

SEQ ID NO: 17684 - DNA, 23 bp, Artificial Sequence
  Synthetic
ccgttttttttttttacatggag

SEQ ID NO: 17685 - DNA, 23 bp, Artificial Sequence
  Synthetic
ccgttttttttttttcaacaaca

SEQ ID NO: 17686 - DNA, 23 bp, Artificial Sequence
  Synthetic
ccgttttttttttttcaacaact

SEQ ID NO: 17687 - DNA, 23 bp, Artificial Sequence
  Synthetic
ccgttttttttttttacaggtag

SEQ ID NO: 17688 - DNA, 23 bp, Artificial Sequence
  Synthetic
ccgttttttttttttgttttgca

SEQ ID NO: 17689 - DNA, 23 bp, Artificial Sequence
  Synthetic
ccgttttttttttttgttttgca

SEQ ID NO: 17690 - DNA, 23 bp, Artificial Sequence
  Synthetic
ccgttttttttttttcctgcact

SEQ ID NO: 17691 - DNA, 23 bp, Artificial Sequence
  Synthetic
ccgttttttttttttatcgttac

SEQ ID NO: 17692 - DNA, 23 bp, Artificial Sequence
  Synthetic
ccgttttttttttttcattacca

SEQ ID NO: 17693 - DNA, 23 bp, Artificial Sequence
  Synthetic
ccgttttttttttttcatgccct

SEQ ID NO: 17694 - DNA, 23 bp, Artificial Sequence
  Synthetic
ccgttttttttttttagtggtcc

SEQ ID NO: 17695 - DNA, 23 bp, Artificial Sequence
  Synthetic
ccgttttttttttttgcatagga

SEQ ID NO: 17696 - DNA, 23 bp, Artificial Sequence
  Synthetic
ccgttttttttttttgactccgg

SEQ ID NO: 17697 - DNA, 23 bp, Artificial Sequence
  Synthetic
ccgttttttttttttcaacacca

SEQ ID NO: 17698 - DNA, 23 bp, Artificial Sequence
  Synthetic
ccgttttttttttttccgctgtc

SEQ ID NO: 17699 - DNA, 23 bp, Artificial Sequence
  Synthetic
ccgttttttttttttccatgact

SEQ ID NO: 17700 - DNA, 23 bp, Artificial Sequence
  Synthetic
ccgttttttttttttcctgtctg

SEQ ID NO: 17701 - DNA, 23 bp, Artificial Sequence
  Synthetic
ccgttttttttttttcagttgcc

SEQ ID NO: 17702 - DNA, 23 bp, Artificial Sequence
  Synthetic
ccgttttttttttttcagttgcc

SEQ ID NO: 17703 - DNA, 23 bp, Artificial Sequence
  Synthetic
ccgttttttttttttaatcagtt

SEQ ID NO: 17704 - DNA, 23 bp, Artificial Sequence
  Synthetic
ccgttttttttttttcatggtta

SEQ ID NO: 17705 - DNA, 23 bp, Artificial Sequence
  Synthetic
ccgttttttttttttatggttag

SEQ ID NO: 17706 - DNA, 23 bp, Artificial Sequence
  Synthetic
ccgttttttttttttgaattgcg

SEQ ID NO: 17707 - DNA, 23 bp, Artificial Sequence
  Synthetic
ccgttttttttttttaacccagc

SEQ ID NO: 17708 - DNA, 23 bp, Artificial Sequence
  Synthetic
ccgttttttttttttgacccagt

SEQ ID NO: 17709 - DNA, 23 bp, Artificial Sequence
  Synthetic
ccgttttttttttttggtatttg

SEQ ID NO: 17710 - DNA, 23 bp, Artificial Sequence
  Synthetic
ccgttttttttttttagttcttc

SEQ ID NO: 17711 - DNA, 23 bp, Artificial Sequence
  Synthetic
ccgttttttttttttagctcttc

SEQ ID NO: 17712 - DNA, 23 bp, Artificial Sequence
  Synthetic
ccgttttttttttttaaatccct

SEQ ID NO: 17713 - DNA, 23 bp, Artificial Sequence
  Synthetic
ccgttttttttttttaatccctg

SEQ ID NO: 17714 - DNA, 23 bp, Artificial Sequence
  Synthetic
ccgttttttttttttcctgctga

SEQ ID NO: 17715 - DNA, 23 bp, Artificial Sequence
  Synthetic
ccgttttttttttttgaccgaga

SEQ ID NO: 17716 - DNA, 23 bp, Artificial Sequence
  Synthetic
ccgttttttttttttcctatcct

SEQ ID NO: 17717 - DNA, 23 bp, Artificial Sequence
  Synthetic
ccgttttttttttttagaactta

SEQ ID NO: 17718 - DNA, 23 bp, Artificial Sequence
  Synthetic
ccgttttttttttttagaactta

SEQ ID NO: 17719 - DNA, 23 bp, Artificial Sequence
  Synthetic
ccgttttttttttttctgaactt

SEQ ID NO: 17720 - DNA, 23 bp, Artificial Sequence
  Synthetic
ccgttttttttttttccgatttc

SEQ ID NO: 17721 - DNA, 23 bp, Artificial Sequence
  Synthetic
ccgttttttttttttactgattt

SEQ ID NO: 17722 - DNA, 23 bp, Artificial Sequence
  Synthetic
ccgttttttttttttgacaatac

SEQ ID NO: 17723 - DNA, 23 bp, Artificial Sequence
  Synthetic
ccgttttttttttttctgagtgt

SEQ ID NO: 17724 - DNA, 23 bp, Artificial Sequence
  Synthetic
ccgttttttttttttgagagtgt

SEQ ID NO: 17725 - DNA, 23 bp, Artificial Sequence
  Synthetic
ccgttttttttttttcagtcggg

SEQ ID NO: 17726 - DNA, 23 bp, Artificial Sequence
  Synthetic
ccgttttttttttttacaaaatc

SEQ ID NO: 17727 - DNA, 23 bp, Artificial Sequence
  Synthetic
ccgttttttttttttaggatttt

SEQ ID NO: 17728 - DNA, 23 bp, Artificial Sequence
  Synthetic
ccgttttttttttttcgcgagcc

SEQ ID NO: 17729 - DNA, 23 bp, Artificial Sequence
  Synthetic
ccgttttttttttttggcattac

SEQ ID NO: 17730 - DNA, 23 bp, Artificial Sequence
  Synthetic
ccgttttttttttttatgtagtc

SEQ ID NO: 17731 - DNA, 23 bp, Artificial Sequence
  Synthetic
ccgttttttttttttagtaccat

SEQ ID NO: 17732 - DNA, 23 bp, Artificial Sequence
  Synthetic
ccgttttttttttttccacattg

SEQ ID NO: 17733 - DNA, 23 bp, Artificial Sequence
  Synthetic
ccgttttttttttttagccgtac

SEQ ID NO: 17734 - DNA, 23 bp, Artificial Sequence
  Synthetic
ccgttttttttttttcaaaatca

SEQ ID NO: 17735 - DNA, 23 bp, Artificial Sequence
  Synthetic
ccgttttttttttttacagctag

SEQ ID NO: 17736 - DNA, 23 bp, Artificial Sequence
  Synthetic
ccgttttttttttttaggccggg

SEQ ID NO: 17737 - DNA, 23 bp, Artificial Sequence
  Synthetic
ccgttttttttttttcaaaaatg

SEQ ID NO: 17738 - DNA, 23 bp, Artificial Sequence
  Synthetic
ccgttttttttttttctatacaa

SEQ ID NO: 17739 - DNA, 23 bp, Artificial Sequence
  Synthetic
ccgttttttttttttccacacaa

SEQ ID NO: 17740 - DNA, 23 bp, Artificial Sequence
  Synthetic
ccgttttttttttttccatacaa

SEQ ID NO: 17741 - DNA, 23 bp, Artificial Sequence
  Synthetic
ccgttttttttttttatgcaacc

SEQ ID NO: 17742 - DNA, 23 bp, Artificial Sequence
  Synthetic
ccgttttttttttttctatacaa

SEQ ID NO: 17743 - DNA, 23 bp, Artificial Sequence
  Synthetic
ccgttttttttttttgtacaaac

SEQ ID NO: 17744 - DNA, 23 bp, Artificial Sequence
  Synthetic
ccgttttttttttttagcacaaa

SEQ ID NO: 17745 - DNA, 23 bp, Artificial Sequence
  Synthetic
ccgttttttttttttctatacaa

SEQ ID NO: 17746 - DNA, 23 bp, Artificial Sequence
  Synthetic
ccgttttttttttttctattcaa

SEQ ID NO: 17747 - DNA, 23 bp, Artificial Sequence
  Synthetic
ccgttttttttttttcaagttcg

SEQ ID NO: 17748 - DNA, 23 bp, Artificial Sequence
  Synthetic
ccgttttttttttttagttatca

SEQ ID NO: 17749 - DNA, 23 bp, Artificial Sequence
  Synthetic
ccgttttttttttttagccctgt

SEQ ID NO: 17750 - DNA, 23 bp, Artificial Sequence
  Synthetic
ccgttttttttttttctgcactg

SEQ ID NO: 17751 - DNA, 23 bp, Artificial Sequence
  Synthetic
ccgttttttttttttagccctgt

SEQ ID NO: 17752 - DNA, 23 bp, Artificial Sequence
  Synthetic
ccgttttttttttttaaattcgg

SEQ ID NO: 17753 - DNA, 23 bp, Artificial Sequence
  Synthetic
ccgttttttttttttaaacacca

SEQ ID NO: 17754 - DNA, 23 bp, Artificial Sequence
  Synthetic
ccgttttttttttttcattcacc

SEQ ID NO: 17755 - DNA, 23 bp, Artificial Sequence
  Synthetic
ccgttttttttttttcattcact

SEQ ID NO: 17756 - DNA, 23 bp, Artificial Sequence
  Synthetic
ccgttttttttttttcaagttag

SEQ ID NO: 17757 - DNA, 23 bp, Artificial Sequence
  Synthetic
ccgttttttttttttgcattatt

SEQ ID NO: 17758 - DNA, 23 bp, Artificial Sequence
  Synthetic
ccgttttttttttttcgtaccaa

SEQ ID NO: 17759 - DNA, 23 bp, Artificial Sequence
  Synthetic
ccgttttttttttttagagaccg

SEQ ID NO: 17760 - DNA, 23 bp, Artificial Sequence
  Synthetic
ccgttttttttttttccctttta

SEQ ID NO: 17761 - DNA, 23 bp, Artificial Sequence
  Synthetic
ccgttttttttttttgccctttc

SEQ ID NO: 17762 - DNA, 23 bp, Artificial Sequence
  Synthetic
ccgttttttttttttagctggtt

SEQ ID NO: 17763 - DNA, 23 bp, Artificial Sequence
  Synthetic
ccgttttttttttttctggttga

SEQ ID NO: 17764 - DNA, 23 bp, Artificial Sequence
  Synthetic
ccgttttttttttttagctggtt

SEQ ID NO: 17765 - DNA, 23 bp, Artificial Sequence
  Synthetic
ccgttttttttttttcataggaa

SEQ ID NO: 17766 - DNA, 23 bp, Artificial Sequence
  Synthetic
ccgttttttttttttcgcgtatt

SEQ ID NO: 17767 - DNA, 23 bp, Artificial Sequence
  Synthetic
ccgttttttttttttcacaacac

SEQ ID NO: 17768 - DNA, 23 bp, Artificial Sequence
  Synthetic
ccgttttttttttttccataggg

SEQ ID NO: 17769 - DNA, 23 bp, Artificial Sequence
  Synthetic
ccgttttttttttttcgtggttc

SEQ ID NO: 17770 - DNA, 23 bp, Artificial Sequence
  Synthetic
ccgttttttttttttataaagta

SEQ ID NO: 17771 - DNA, 23 bp, Artificial Sequence
  Synthetic
ccgttttttttttttgtgctttc

SEQ ID NO: 17772 - DNA, 23 bp, Artificial Sequence
  Synthetic
ccgttttttttttttgtacatca

SEQ ID NO: 17773 - DNA, 23 bp, Artificial Sequence
  Synthetic
ccgttttttttttttcccatgga

SEQ ID NO: 17774 - DNA, 23 bp, Artificial Sequence
  Synthetic
ccgttttttttttttcctatgga

SEQ ID NO: 17775 - DNA, 23 bp, Artificial Sequence
  Synthetic
ccgttttttttttttagaactga

SEQ ID NO: 17776 - DNA, 23 bp, Artificial Sequence
  Synthetic
ccgttttttttttttagaagcat

SEQ ID NO: 17777 - DNA, 23 bp, Artificial Sequence
  Synthetic
ccgttttttttttttaaagttct

SEQ ID NO: 17778 - DNA, 23 bp, Artificial Sequence
  Synthetic
ccgttttttttttttcttttgtg

SEQ ID NO: 17779 - DNA, 23 bp, Artificial Sequence
  Synthetic
ccgttttttttttttcctatcac

SEQ ID NO: 17780 - DNA, 23 bp, Artificial Sequence
  Synthetic
ccgttttttttttttaaaccatt

SEQ ID NO: 17781 - DNA, 23 bp, Artificial Sequence
  Synthetic
ccgttttttttttttaaaccatg

SEQ ID NO: 17782 - DNA, 23 bp, Artificial Sequence
  Synthetic
ccgttttttttttttccaatatt

SEQ ID NO: 17783 - DNA, 23 bp, Artificial Sequence
  Synthetic
ccgttttttttttttaagtgcct

SEQ ID NO: 17784 - DNA, 23 bp, Artificial Sequence
  Synthetic
ccgttttttttttttacctgcac

SEQ ID NO: 17785 - DNA, 23 bp, Artificial Sequence
  Synthetic
ccgttttttttttttcaccgaca

SEQ ID NO: 17786 - DNA, 23 bp, Artificial Sequence
  Synthetic
ccgttttttttttttacaatcaa

SEQ ID NO: 17787 - DNA, 23 bp, Artificial Sequence
  Synthetic
ccgttttttttttttcaccgaca

SEQ ID NO: 17788 - DNA, 23 bp, Artificial Sequence
  Synthetic
ccgttttttttttttgtgaattc

SEQ ID NO: 17789 - DNA, 23 bp, Artificial Sequence
  Synthetic
ccgttttttttttttccttatca

SEQ ID NO: 17790 - DNA, 23 bp, Artificial Sequence
  Synthetic
ccgttttttttttttctgcaaca

SEQ ID NO: 17791 - DNA, 23 bp, Artificial Sequence
  Synthetic
ccgttttttttttttgcactaga

SEQ ID NO: 17792 - DNA, 23 bp, Artificial Sequence
  Synthetic
ccgttttttttttttctgcacta

SEQ ID NO: 17793 - DNA, 23 bp, Artificial Sequence
  Synthetic
ccgttttttttttttctaatata

SEQ ID NO: 17794 - DNA, 23 bp, Artificial Sequence
  Synthetic
ccgttttttttttttagcgggac

SEQ ID NO: 17795 - DNA, 23 bp, Artificial Sequence
  Synthetic
ccgttttttttttttacatggag

SEQ ID NO: 17796 - DNA, 23 bp, Artificial Sequence
  Synthetic
ccgttttttttttttaacaacat

SEQ ID NO: 17797 - DNA, 23 bp, Artificial Sequence
  Synthetic
ccgttttttttttttacaggtag

SEQ ID NO: 17798 - DNA, 23 bp, Artificial Sequence
  Synthetic
ccgttttttttttttaatgtgca

SEQ ID NO: 17799 - DNA, 23 bp, Artificial Sequence
  Synthetic
ccgttttttttttttgttttgca

SEQ ID NO: 17800 - DNA, 23 bp, Artificial Sequence
  Synthetic
ccgttttttttttttgttttgca

SEQ ID NO: 17801 - DNA, 23 bp, Artificial Sequence
  Synthetic
ccgttttttttttttatacttct

SEQ ID NO: 17802 - DNA, 23 bp, Artificial Sequence
  Synthetic
ccgttttttttttttatacttct

SEQ ID NO: 17803 - DNA, 23 bp, Artificial Sequence
  Synthetic
ccgttttttttttttatcgttac

SEQ ID NO: 17804 - DNA, 23 bp, Artificial Sequence
  Synthetic
ccgttttttttttttatcattac

SEQ ID NO: 17805 - DNA, 23 bp, Artificial Sequence
  Synthetic
ccgttttttttttttcatgctct

SEQ ID NO: 17806 - DNA, 23 bp, Artificial Sequence
  Synthetic
ccgttttttttttttagaagtat

SEQ ID NO: 17807 - DNA, 23 bp, Artificial Sequence
  Synthetic
ccgttttttttttttagtggtcc

SEQ ID NO: 17808 - DNA, 23 bp, Artificial Sequence
  Synthetic
ccgttttttttttttgcatagga

SEQ ID NO: 17809 - DNA, 23 bp, Artificial Sequence
  Synthetic
ccgttttttttttttgactccgg

SEQ ID NO: 17810 - DNA, 23 bp, Artificial Sequence
  Synthetic
ccgttttttttttttgattccgg

SEQ ID NO: 17811 - DNA, 23 bp, Artificial Sequence
  Synthetic
ccgttttttttttttacacactt

SEQ ID NO: 17812 - DNA, 23 bp, Artificial Sequence
  Synthetic
ccgttttttttttttcctgcact

SEQ ID NO: 17813 - DNA, 23 bp, Artificial Sequence
  Synthetic
ccgttttttttttttcctgcact

SEQ ID NO: 17814 - DNA, 23 bp, Artificial Sequence
  Synthetic
ccgttttttttttttacatcagt

SEQ ID NO: 17815 - DNA, 23 bp, Artificial Sequence
  Synthetic
ccgttttttttttttgcatagga

SEQ ID NO: 17816 - DNA, 23 bp, Artificial Sequence
  Synthetic
ccgttttttttttttgtcaattc

SEQ ID NO: 17817 - DNA, 23 bp, Artificial Sequence
  Synthetic
ccgttttttttttttcagttgcc

SEQ ID NO: 17818 - DNA, 23 bp, Artificial Sequence
  Synthetic
ccgttttttttttttcaatcagt

SEQ ID NO: 17819 - DNA, 23 bp, Artificial Sequence
  Synthetic
ccgttttttttttttatggttag

SEQ ID NO: 17820 - DNA, 23 bp, Artificial Sequence
  Synthetic
ccgttttttttttttaattgcgt

SEQ ID NO: 17821 - DNA, 23 bp, Artificial Sequence
  Synthetic
ccgttttttttttttaacccagc

SEQ ID NO: 17822 - DNA, 23 bp, Artificial Sequence
  Synthetic
ccgttttttttttttgacccagt

SEQ ID NO: 17823 - DNA, 23 bp, Artificial Sequence
  Synthetic
ccgttttttttttttgacccagt

SEQ ID NO: 17824 - DNA, 23 bp, Artificial Sequence
  Synthetic
ccgttttttttttttggtatttg

SEQ ID NO: 17825 - DNA, 23 bp, Artificial Sequence
  Synthetic
ccgttttttttttttaatccctg

SEQ ID NO: 17826 - DNA, 23 bp, Artificial Sequence
  Synthetic
ccgttttttttttttcctgctga

SEQ ID NO: 17827 - DNA, 23 bp, Artificial Sequence
  Synthetic
ccgttttttttttttctatcctg

SEQ ID NO: 17828 - DNA, 23 bp, Artificial Sequence
  Synthetic
ccgttttttttttttagaactta

SEQ ID NO: 17829 - DNA, 23 bp, Artificial Sequence
  Synthetic
ccgttttttttttttccgatttc

SEQ ID NO: 17830 - DNA, 23 bp, Artificial Sequence
  Synthetic
ccgttttttttttttcactgatt

SEQ ID NO: 17831 - DNA, 23 bp, Artificial Sequence
  Synthetic
ccgttttttttttttcgatttca

SEQ ID NO: 17832 - DNA, 23 bp, Artificial Sequence
  Synthetic
ccgttttttttttttctttgaca

SEQ ID NO: 17833 - DNA, 23 bp, Artificial Sequence
  Synthetic
ccgttttttttttttctaaaaca

SEQ ID NO: 17834 - DNA, 23 bp, Artificial Sequence
  Synthetic
ccgttttttttttttctaaaaca

SEQ ID NO: 17835 - DNA, 23 bp, Artificial Sequence
  Synthetic
ccgttttttttttttaaagcacc

SEQ ID NO: 17836 - DNA, 23 bp, Artificial Sequence
  Synthetic
ccgttttttttttttactgaaac

SEQ ID NO: 17837 - DNA, 23 bp, Artificial Sequence
  Synthetic
ccgttttttttttttgcaggtac

SEQ ID NO: 17838 - DNA, 23 bp, Artificial Sequence
  Synthetic
ccgttttttttttttactaaaac

SEQ ID NO: 17839 - DNA, 23 bp, Artificial Sequence
  Synthetic
ccgttttttttttttgcaaacat

SEQ ID NO: 17840 - DNA, 23 bp, Artificial Sequence
  Synthetic
ccgttttttttttttcagtcgag

SEQ ID NO: 17841 - DNA, 23 bp, Artificial Sequence
  Synthetic
ccgttttttttttttctgagtgt

SEQ ID NO: 17842 - DNA, 23 bp, Artificial Sequence
  Synthetic
ccgttttttttttttctgagagt

SEQ ID NO: 17843 - DNA, 23 bp, Artificial Sequence
  Synthetic
ccgttttttttttttcagtcggg

SEQ ID NO: 17844 - DNA, 23 bp, Artificial Sequence
  Synthetic
ccgttttttttttttagtcaagg

SEQ ID NO: 17845 - DNA, 23 bp, Artificial Sequence
  Synthetic
ccgttttttttttttgctatgcc

SEQ ID NO: 17846 - DNA, 23 bp, Artificial Sequence
  Synthetic
ccgttttttttttttaacttagt

SEQ ID NO: 17847 - DNA, 23 bp, Artificial Sequence
  Synthetic
ccgttttttttttttatgcaact

SEQ ID NO: 17848 - DNA, 23 bp, Artificial Sequence
  Synthetic
ccgttttttttttttcaaccagc

SEQ ID NO: 17849 - DNA, 23 bp, Artificial Sequence
  Synthetic
ccgttttttttttttatcagcta

SEQ ID NO: 17850 - DNA, 23 bp, Artificial Sequence
  Synthetic
ccgttttttttttttaatcagct

SEQ ID NO: 17851 - DNA, 23 bp, Artificial Sequence
  Synthetic
ccgttttttttttttaggatttt

SEQ ID NO: 17852 - DNA, 23 bp, Artificial Sequence
  Synthetic
ccgttttttttttttccattgct

SEQ ID NO: 17853 - DNA, 23 bp, Artificial Sequence
  Synthetic
ccgttttttttttttcgcgagcc

SEQ ID NO: 17854 - DNA, 23 bp, Artificial Sequence
  Synthetic
ccgttttttttttttccacaatc

SEQ ID NO: 17855 - DNA, 23 bp, Artificial Sequence
  Synthetic
ccgttttttttttttggcattac

SEQ ID NO: 17856 - DNA, 23 bp, Artificial Sequence
  Synthetic
ccgttttttttttttcagctaac

SEQ ID NO: 17857 - DNA, 23 bp, Artificial Sequence
  Synthetic
ccgttttttttttttactcagta

SEQ ID NO: 17858 - DNA, 23 bp, Artificial Sequence
  Synthetic
ccgttttttttttttatgtagtc

SEQ ID NO: 17859 - DNA, 23 bp, Artificial Sequence
  Synthetic
ccgttttttttttttcaaccatc

SEQ ID NO: 17860 - DNA, 23 bp, Artificial Sequence
  Synthetic
ccgttttttttttttcacagtgt

SEQ ID NO: 17861 - DNA, 23 bp, Artificial Sequence
  Synthetic
ccgttttttttttttatgtgtgt

SEQ ID NO: 17862 - DNA, 23 bp, Artificial Sequence
  Synthetic
ccgttttttttttttagccgtac

SEQ ID NO: 17863 - DNA, 23 bp, Artificial Sequence
  Synthetic
ccgttttttttttttgcatggag

SEQ ID NO: 17864 - DNA, 23 bp, Artificial Sequence
  Synthetic
ccgttttttttttttaacatcac

SEQ ID NO: 17865 - DNA, 23 bp, Artificial Sequence
  Synthetic
ccgttttttttttttacaaaatc

SEQ ID NO: 17866 - DNA, 23 bp, Artificial Sequence
  Synthetic
ccgttttttttttttatcccatc

SEQ ID NO: 17867 - DNA, 23 bp, Artificial Sequence
  Synthetic
ccgttttttttttttcaaaaatc

SEQ ID NO: 17868 - DNA, 23 bp, Artificial Sequence
  Synthetic
ccgttttttttttttacagctag

SEQ ID NO: 17869 - DNA, 23 bp, Artificial Sequence
  Synthetic
ccgttttttttttttattcggtt

SEQ ID NO: 17870 - DNA, 23 bp, Artificial Sequence
  Synthetic
ccgttttttttttttggccggga

SEQ ID NO: 17871 - DNA, 23 bp, Artificial Sequence
  Synthetic
ccgttttttttttttcaagatcg

SEQ ID NO: 17872 - DNA, 23 bp, Artificial Sequence
  Synthetic
ccgttttttttttttcaagttcg

SEQ ID NO: 17873 - DNA, 23 bp, Artificial Sequence
  Synthetic
ccgttttttttttttagttatca

SEQ ID NO: 17874 - DNA, 23 bp, Artificial Sequence
  Synthetic
ccgttttttttttttagccctgt

SEQ ID NO: 17875 - DNA, 23 bp, Artificial Sequence
  Synthetic
ccgttttttttttttaggagtct

SEQ ID NO: 17876 - DNA, 23 bp, Artificial Sequence
  Synthetic
ccgttttttttttttacctgcac

SEQ ID NO: 17877 - DNA, 23 bp, Artificial Sequence
  Synthetic
ccgttttttttttttgcactgtc

SEQ ID NO: 17878 - DNA, 23 bp, Artificial Sequence
  Synthetic
ccgttttttttttttagccctgt

SEQ ID NO: 17879 - DNA, 23 bp, Artificial Sequence
  Synthetic
ccgttttttttttttcaaattcg

SEQ ID NO: 17880 - DNA, 23 bp, Artificial Sequence
  Synthetic
ccgttttttttttttaaattcgg

SEQ ID NO: 17881 - DNA, 23 bp, Artificial Sequence
  Synthetic
ccgttttttttttttcattcacc

SEQ ID NO: 17882 - DNA, 23 bp, Artificial Sequence
  Synthetic
ccgttttttttttttcaagttag

SEQ ID NO: 17883 - DNA, 23 bp, Artificial Sequence
  Synthetic
ccgttttttttttttccttttaa

SEQ ID NO: 17884 - DNA, 23 bp, Artificial Sequence
  Synthetic
ccgttttttttttttagctggtt

SEQ ID NO: 17885 - DNA, 23 bp, Artificial Sequence
  Synthetic
ccgttttttttttttctctggtc

SEQ ID NO: 17886 - DNA, 23 bp, Artificial Sequence
  Synthetic
ccgttttttttttttcataggaa

SEQ ID NO: 17887 - DNA, 23 bp, Artificial Sequence
  Synthetic
ccgttttttttttttatcatcaa

SEQ ID NO: 17888 - DNA, 23 bp, Artificial Sequence
  Synthetic
ccgttttttttttttatctttac

SEQ ID NO: 17889 - DNA, 23 bp, Artificial Sequence
  Synthetic
ccgttttttttttttgctacagt

SEQ ID NO: 17890 - DNA, 23 bp, Artificial Sequence
  Synthetic
ccgttttttttttttgggattcc

SEQ ID NO: 17891 - DNA, 23 bp, Artificial Sequence
  Synthetic
ccgttttttttttttcttttgtg

SEQ ID NO: 17892 - DNA, 23 bp, Artificial Sequence
  Synthetic
ccgttttttttttttaaggcaac

SEQ ID NO: 17893 - DNA, 23 bp, Artificial Sequence
  Synthetic
ccgttttttttttttcaaaccat

SEQ ID NO: 17894 - DNA, 23 bp, Artificial Sequence
  Synthetic
ccgttttttttttttaaccatga

SEQ ID NO: 17895 - DNA, 23 bp, Artificial Sequence
  Synthetic
ccgttttttttttttccaatatt

SEQ ID NO: 17896 - DNA, 23 bp, Artificial Sequence
  Synthetic
ccgttttttttttttaagtgcct

SEQ ID NO: 17897 - DNA, 23 bp, Artificial Sequence
  Synthetic
ccgttttttttttttacctgcac

SEQ ID NO: 17898 - DNA, 23 bp, Artificial Sequence
  Synthetic
ccgttttttttttttgcactaga

SEQ ID NO: 17899 - DNA, 23 bp, Artificial Sequence
  Synthetic
ccgttttttttttttcaccgaca

SEQ ID NO: 17900 - DNA, 23 bp, Artificial Sequence
  Synthetic
ccgttttttttttttacaatcaa

SEQ ID NO: 17901 - DNA, 23 bp, Artificial Sequence
  Synthetic
ccgttttttttttttcccaccga

SEQ ID NO: 17902 - DNA, 23 bp, Artificial Sequence
  Synthetic
ccgttttttttttttcaccgaca

SEQ ID NO: 17903 - DNA, 23 bp, Artificial Sequence
  Synthetic
ccgttttttttttttgtgaattc

SEQ ID NO: 17904 - DNA, 23 bp, Artificial Sequence
  Synthetic
ccgttttttttttttgcccaaaa

SEQ ID NO: 17905 - DNA, 23 bp, Artificial Sequence
  Synthetic
ccgttttttttttttgctgcaac

SEQ ID NO: 17906 - DNA, 23 bp, Artificial Sequence
  Synthetic
ccgttttttttttttctaatata

SEQ ID NO: 17907 - DNA, 23 bp, Artificial Sequence
  Synthetic
ccgttttttttttttacatggag

SEQ ID NO: 17908 - DNA, 23 bp, Artificial Sequence
  Synthetic
ccgttttttttttttcaatattt

SEQ ID NO: 17909 - DNA, 23 bp, Artificial Sequence
  Synthetic
ccgttttttttttttaacaacat

SEQ ID NO: 17910 - DNA, 23 bp, Artificial Sequence
  Synthetic
ccgttttttttttttatctcccc

SEQ ID NO: 17911 - DNA, 23 bp, Artificial Sequence
  Synthetic
ccgttttttttttttacaggtag

SEQ ID NO: 17912 - DNA, 23 bp, Artificial Sequence
  Synthetic
ccgttttttttttttgttttgca

SEQ ID NO: 17913 - DNA, 23 bp, Artificial Sequence
  Synthetic
ccgttttttttttttgttttgca

SEQ ID NO: 17914 - DNA, 23 bp, Artificial Sequence
  Synthetic
ccgttttttttttttctgcacta

SEQ ID NO: 17915 - DNA, 23 bp, Artificial Sequence
  Synthetic
ccgttttttttttttatcattac

SEQ ID NO: 17916 - DNA, 23 bp, Artificial Sequence
  Synthetic
ccgttttttttttttgcatagga

SEQ ID NO: 17917 - DNA, 23 bp, Artificial Sequence
  Synthetic
ccgttttttttttttgactccgg

SEQ ID NO: 17918 - DNA, 23 bp, Artificial Sequence
  Synthetic
ccgttttttttttttacatcagt

SEQ ID NO: 17919 - DNA, 23 bp, Artificial Sequence
  Synthetic
ccgttttttttttttcctgtctg

SEQ ID NO: 17920 - DNA, 23 bp, Artificial Sequence
  Synthetic
ccgttttttttttttgtcaattc

SEQ ID NO: 17921 - DNA, 23 bp, Artificial Sequence
  Synthetic
ccgttttttttttttcagttgcc

SEQ ID NO: 17922 - DNA, 23 bp, Artificial Sequence
  Synthetic
ccgttttttttttttcaatcagt

SEQ ID NO: 17923 - DNA, 23 bp, Artificial Sequence
  Synthetic
ccgttttttttttttatggttag

SEQ ID NO: 17924 - DNA, 23 bp, Artificial Sequence
  Synthetic
ccgttttttttttttaattgcgt

SEQ ID NO: 17925 - DNA, 23 bp, Artificial Sequence
  Synthetic
ccgttttttttttttagtgtcag

SEQ ID NO: 17926 - DNA, 23 bp, Artificial Sequence
  Synthetic
ccgttttttttttttaacccagc

SEQ ID NO: 17927 - DNA, 23 bp, Artificial Sequence
  Synthetic
ccgttttttttttttggtatttg

SEQ ID NO: 17928 - DNA, 23 bp, Artificial Sequence
  Synthetic
ccgttttttttttttacggaacc

SEQ ID NO: 17929 - DNA, 23 bp, Artificial Sequence
  Synthetic
ccgttttttttttttaaatccct

SEQ ID NO: 17930 - DNA, 23 bp, Artificial Sequence
  Synthetic
ccgttttttttttttcctgctga

SEQ ID NO: 17931 - DNA, 23 bp, Artificial Sequence
  Synthetic
ccgttttttttttttgaccgaga

SEQ ID NO: 17932 - DNA, 23 bp, Artificial Sequence
  Synthetic
ccgttttttttttttcctatcct

SEQ ID NO: 17933 - DNA, 23 bp, Artificial Sequence
  Synthetic
ccgttttttttttttcggaactt

SEQ ID NO: 17934 - DNA, 23 bp, Artificial Sequence
  Synthetic
ccgttttttttttttaatagact

SEQ ID NO: 17935 - DNA, 23 bp, Artificial Sequence
  Synthetic
ccgttttttttttttccgatttc

SEQ ID NO: 17936 - DNA, 23 bp, Artificial Sequence
  Synthetic
ccgttttttttttttgatttcaa

SEQ ID NO: 17937 - DNA, 23 bp, Artificial Sequence
  Synthetic
ccgttttttttttttgcaaacat

SEQ ID NO: 17938 - DNA, 23 bp, Artificial Sequence
  Synthetic
ccgttttttttttttcagtcgag

SEQ ID NO: 17939 - DNA, 23 bp, Artificial Sequence
  Synthetic
ccgttttttttttttgagtgtag

SEQ ID NO: 17940 - DNA, 23 bp, Artificial Sequence
  Synthetic
ccgttttttttttttcagtcggg

SEQ ID NO: 17941 - DNA, 23 bp, Artificial Sequence
  Synthetic
ccgttttttttttttgctatgcc

SEQ ID NO: 17942 - DNA, 23 bp, Artificial Sequence
  Synthetic
ccgttttttttttttaacttagt

SEQ ID NO: 17943 - DNA, 23 bp, Artificial Sequence
  Synthetic
ccgttttttttttttatgcaact

SEQ ID NO: 17944 - DNA, 23 bp, Artificial Sequence
  Synthetic
ccgttttttttttttaaccagct

SEQ ID NO: 17945 - DNA, 23 bp, Artificial Sequence
  Synthetic
ccgttttttttttttcaaaatca

SEQ ID NO: 17946 - DNA, 23 bp, Artificial Sequence
  Synthetic
ccgttttttttttttacagctag

SEQ ID NO: 17947 - DNA, 23 bp, Artificial Sequence
  Synthetic
ccgttttttttttttaggccggg

SEQ ID NO: 17948 - DNA, 23 bp, Artificial Sequence
  Synthetic
ccgttttttttttttcctgcacg

SEQ ID NO: 17949 - DNA, 23 bp, Artificial Sequence
  Synthetic
ccgttttttttttttcaataaat

SEQ ID NO: 17950 - DNA, 23 bp, Artificial Sequence
  Synthetic
ccgttttttttttttaaaaatgt

SEQ ID NO: 17951 - DNA, 23 bp, Artificial Sequence
  Synthetic
ccgttttttttttttcaatacaa

SEQ ID NO: 17952 - DNA, 23 bp, Artificial Sequence
  Synthetic
ccgttttttttttttcaagatcg

SEQ ID NO: 17953 - DNA, 23 bp, Artificial Sequence
  Synthetic
ccgttttttttttttctcactct

SEQ ID NO: 17954 - DNA, 23 bp, Artificial Sequence
  Synthetic
ccgttttttttttttctctctct

SEQ ID NO: 17955 - DNA, 23 bp, Artificial Sequence
  Synthetic
ccgttttttttttttctctctat

SEQ ID NO: 17956 - DNA, 23 bp, Artificial Sequence
  Synthetic
ccgttttttttttttctctctat

SEQ ID NO: 17957 - DNA, 23 bp, Artificial Sequence
  Synthetic
ccgttttttttttttctctctat

SEQ ID NO: 17958 - DNA, 23 bp, Artificial Sequence
  Synthetic
ccgttttttttttttagctccct

SEQ ID NO: 17959 - DNA, 23 bp, Artificial Sequence
  Synthetic
ccgttttttttttttcatacagg

SEQ ID NO: 17960 - DNA, 23 bp, Artificial Sequence
  Synthetic
ccgttttttttttttggaatgaa

SEQ ID NO: 17961 - DNA, 23 bp, Artificial Sequence
  Synthetic
ccgttttttttttttggaatgaa

SEQ ID NO: 17962 - DNA, 23 bp, Artificial Sequence
  Synthetic
ccgttttttttttttatcatgct

SEQ ID NO: 17963 - DNA, 23 bp, Artificial Sequence
  Synthetic
ccgttttttttttttatcatgct

SEQ ID NO: 17964 - DNA, 23 bp, Artificial Sequence
  Synthetic
ccgttttttttttttcgacctgc

SEQ ID NO: 17965 - DNA, 23 bp, Artificial Sequence
  Synthetic
ccgttttttttttttggcaagtc

SEQ ID NO: 17966 - DNA, 23 bp, Artificial Sequence
  Synthetic
ccgttttttttttttcagcatca

SEQ ID NO: 17967 - DNA, 23 bp, Artificial Sequence
  Synthetic
ccgttttttttttttcagcatca

SEQ ID NO: 17968 - DNA, 23 bp, Artificial Sequence
  Synthetic
ccgttttttttttttgagctccc

SEQ ID NO: 17969 - DNA, 23 bp, Artificial Sequence
  Synthetic
ccgttttttttttttgagctccc

SEQ ID NO: 17970 - DNA, 23 bp, Artificial Sequence
  Synthetic
ccgttttttttttttgagctcct

SEQ ID NO: 17971 - DNA, 23 bp, Artificial Sequence
  Synthetic
ccgttttttttttttgttcaaga

SEQ ID NO: 17972 - DNA, 23 bp, Artificial Sequence
  Synthetic
ccgttttttttttttgttcaaga

SEQ ID NO: 17973 - DNA, 23 bp, Artificial Sequence
  Synthetic
ccgttttttttttttggggtgac

SEQ ID NO: 17974 - DNA, 23 bp, Artificial Sequence
  Synthetic
ccgttttttttttttggggtgac

SEQ ID NO: 17975 - DNA, 23 bp, Artificial Sequence
  Synthetic
ccgttttttttttttcctggatc

SEQ ID NO: 17976 - DNA, 23 bp, Artificial Sequence
  Synthetic
ccgttttttttttttgtgaagaa

SEQ ID NO: 17977 - DNA, 23 bp, Artificial Sequence
  Synthetic
ccgttttttttttttacgggaag

SEQ ID NO: 17978 - DNA, 23 bp, Artificial Sequence
  Synthetic
ccgttttttttttttcaaactag

SEQ ID NO: 17979 - DNA, 23 bp, Artificial Sequence
  Synthetic
ccgttttttttttttcaggtgtc

SEQ ID NO: 17980 - DNA, 23 bp, Artificial Sequence
  Synthetic
ccgttttttttttttgcgcgcca

SEQ ID NO: 17981 - DNA, 23 bp, Artificial Sequence
  Synthetic
ccgttttttttttttgacgaggc

SEQ ID NO: 17982 - DNA, 23 bp, Artificial Sequence
  Synthetic
ccgttttttttttttccgagcca

SEQ ID NO: 17983 - DNA, 23 bp, Artificial Sequence
  Synthetic
ccgttttttttttttgcgggagc

SEQ ID NO: 17984 - DNA, 23 bp, Artificial Sequence
  Synthetic
ccgttttttttttttccacctga

SEQ ID NO: 17985 - DNA, 23 bp, Artificial Sequence
  Synthetic
ccgttttttttttttcccacggt

SEQ ID NO: 17986 - DNA, 23 bp, Artificial Sequence
  Synthetic
ccgttttttttttttcccctgca

SEQ ID NO: 17987 - DNA, 23 bp, Artificial Sequence
  Synthetic
ccgttttttttttttgctctcgt

SEQ ID NO: 17988 - DNA, 23 bp, Artificial Sequence
  Synthetic
ccgttttttttttttcatcgtca

SEQ ID NO: 17989 - DNA, 23 bp, Artificial Sequence
  Synthetic
ccgttttttttttttctatacaa

SEQ ID NO: 17990 - DNA, 23 bp, Artificial Sequence
  Synthetic
ccgttttttttttttccacacaa

SEQ ID NO: 17991 - DNA, 23 bp, Artificial Sequence
  Synthetic
ccgttttttttttttccatacaa

SEQ ID NO: 17992 - DNA, 23 bp, Artificial Sequence
  Synthetic
ccgttttttttttttatgcaacc

SEQ ID NO: 17993 - DNA, 23 bp, Artificial Sequence
  Synthetic
ccgttttttttttttatacaacc

SEQ ID NO: 17994 - DNA, 23 bp, Artificial Sequence
  Synthetic
ccgttttttttttttctatacaa

SEQ ID NO: 17995 - DNA, 23 bp, Artificial Sequence
  Synthetic
ccgttttttttttttgtacaaac

SEQ ID NO: 17996 - DNA, 23 bp, Artificial Sequence
  Synthetic
ccgttttttttttttagcacaaa

SEQ ID NO: 17997 - DNA, 23 bp, Artificial Sequence
  Synthetic
ccgttttttttttttatacttct

SEQ ID NO: 17998 - DNA, 23 bp, Artificial Sequence
  Synthetic
ccgttttttttttttcaagttcg

SEQ ID NO: 17999 - DNA, 23 bp, Artificial Sequence
  Synthetic
ccgttttttttttttagttatca

SEQ ID NO: 18000 - DNA, 23 bp, Artificial Sequence
  Synthetic
ccgttttttttttttagccctgt

SEQ ID NO: 18001 - DNA, 23 bp, Artificial Sequence
  Synthetic
ccgttttttttttttaggagtct

SEQ ID NO: 18002 - DNA, 23 bp, Artificial Sequence
  Synthetic
ccgttttttttttttacctgcac

SEQ ID NO: 18003 - DNA, 23 bp, Artificial Sequence
  Synthetic
ccgttttttttttttgcactgtc

SEQ ID NO: 18004 - DNA, 23 bp, Artificial Sequence
  Synthetic
ccgttttttttttttagccctgt

SEQ ID NO: 18005 - DNA, 23 bp, Artificial Sequence
  Synthetic
ccgttttttttttttcaaattcg

SEQ ID NO: 18006 - DNA, 23 bp, Artificial Sequence
  Synthetic
ccgttttttttttttaaattcgg

SEQ ID NO: 18007 - DNA, 23 bp, Artificial Sequence
  Synthetic
ccgttttttttttttaaacacca

SEQ ID NO: 18008 - DNA, 23 bp, Artificial Sequence
  Synthetic
ccgttttttttttttcattcacc

SEQ ID NO: 18009 - DNA, 23 bp, Artificial Sequence
  Synthetic
ccgttttttttttttcaggttaa

SEQ ID NO: 18010 - DNA, 23 bp, Artificial Sequence
  Synthetic
ccgttttttttttttcaagttag

SEQ ID NO: 18011 - DNA, 23 bp, Artificial Sequence
  Synthetic
ccgttttttttttttattattac

SEQ ID NO: 18012 - DNA, 23 bp, Artificial Sequence
  Synthetic
ccgttttttttttttcgtaccaa

SEQ ID NO: 18013 - DNA, 23 bp, Artificial Sequence
  Synthetic
ccgttttttttttttccaagctc

SEQ ID NO: 18014 - DNA, 23 bp, Artificial Sequence
  Synthetic
ccgttttttttttttaagagacc

SEQ ID NO: 18015 - DNA, 23 bp, Artificial Sequence
  Synthetic
ccgttttttttttttaagagacc

SEQ ID NO: 18016 - DNA, 23 bp, Artificial Sequence
  Synthetic
ccgttttttttttttaagcccag

SEQ ID NO: 18017 - DNA, 23 bp, Artificial Sequence
  Synthetic
ccgttttttttttttccctttta

SEQ ID NO: 18018 - DNA, 23 bp, Artificial Sequence
  Synthetic
ccgttttttttttttccctttca

SEQ ID NO: 18019 - DNA, 23 bp, Artificial Sequence
  Synthetic
ccgttttttttttttaccatggc

SEQ ID NO: 18020 - DNA, 23 bp, Artificial Sequence
  Synthetic
ccgttttttttttttagctggtt

SEQ ID NO: 18021 - DNA, 23 bp, Artificial Sequence
  Synthetic
ccgttttttttttttctggttga

SEQ ID NO: 18022 - DNA, 23 bp, Artificial Sequence
  Synthetic
ccgttttttttttttctctggtc

SEQ ID NO: 18023 - DNA, 23 bp, Artificial Sequence
  Synthetic
ccgttttttttttttcataggaa

SEQ ID NO: 18024 - DNA, 23 bp, Artificial Sequence
  Synthetic
ccgttttttttttttcataggaa

SEQ ID NO: 18025 - DNA, 23 bp, Artificial Sequence
  Synthetic
ccgttttttttttttatcatcaa

SEQ ID NO: 18026 - DNA, 23 bp, Artificial Sequence
  Synthetic
ccgttttttttttttcgcgtatt

SEQ ID NO: 18027 - DNA, 23 bp, Artificial Sequence
  Synthetic
ccgttttttttttttcacaacac

SEQ ID NO: 18028 - DNA, 23 bp, Artificial Sequence
  Synthetic
ccgttttttttttttacacgtgc

SEQ ID NO: 18029 - DNA, 23 bp, Artificial Sequence
  Synthetic
ccgttttttttttttccataggg

SEQ ID NO: 18030 - DNA, 23 bp, Artificial Sequence
  Synthetic
ccgttttttttttttatctttac

SEQ ID NO: 18031 - DNA, 23 bp, Artificial Sequence
  Synthetic
ccgttttttttttttataaagta

SEQ ID NO: 18032 - DNA, 23 bp, Artificial Sequence
  Synthetic
ccgttttttttttttgtgctttc

SEQ ID NO: 18033 - DNA, 23 bp, Artificial Sequence
  Synthetic
ccgttttttttttttgctacagt

SEQ ID NO: 18034 - DNA, 23 bp, Artificial Sequence
  Synthetic
ccgttttttttttttgtacatca

SEQ ID NO: 18035 - DNA, 23 bp, Artificial Sequence
  Synthetic
ccgttttttttttttgggattcc

SEQ ID NO: 18036 - DNA, 23 bp, Artificial Sequence
  Synthetic
ccgttttttttttttcccatgga

SEQ ID NO: 18037 - DNA, 23 bp, Artificial Sequence
  Synthetic
ccgttttttttttttcctatgga

SEQ ID NO: 18038 - DNA, 23 bp, Artificial Sequence
  Synthetic
ccgttttttttttttagaagcat

SEQ ID NO: 18039 - DNA, 23 bp, Artificial Sequence
  Synthetic
ccgttttttttttttaaagttct

SEQ ID NO: 18040 - DNA, 23 bp, Artificial Sequence
  Synthetic
ccgttttttttttttaaagttct

SEQ ID NO: 18041 - DNA, 23 bp, Artificial Sequence
  Synthetic
ccgttttttttttttagtgaaga

SEQ ID NO: 18042 - DNA, 23 bp, Artificial Sequence
  Synthetic
ccgttttttttttttctggtaca

SEQ ID NO: 18043 - DNA, 23 bp, Artificial Sequence
  Synthetic
ccgttttttttttttcaaggagc

SEQ ID NO: 18044 - DNA, 23 bp, Artificial Sequence
  Synthetic
ccgttttttttttttcaagttct

SEQ ID NO: 18045 - DNA, 23 bp, Artificial Sequence
  Synthetic
ccgttttttttttttcttttgtg

SEQ ID NO: 18046 - DNA, 23 bp, Artificial Sequence
  Synthetic
ccgttttttttttttaaggcaac

SEQ ID NO: 18047 - DNA, 23 bp, Artificial Sequence
  Synthetic
ccgttttttttttttaggtcaac

SEQ ID NO: 18048 - DNA, 23 bp, Artificial Sequence
  Synthetic
ccgttttttttttttcctatcac

SEQ ID NO: 18049 - DNA, 23 bp, Artificial Sequence
  Synthetic
ccgttttttttttttcaaaccat

SEQ ID NO: 18050 - DNA, 23 bp, Artificial Sequence
  Synthetic
ccgttttttttttttaaccatga

SEQ ID NO: 18051 - DNA, 23 bp, Artificial Sequence
  Synthetic
ccgttttttttttttccaatatt

SEQ ID NO: 18052 - DNA, 23 bp, Artificial Sequence
  Synthetic
ccgttttttttttttaagtgcct

SEQ ID NO: 18053 - DNA, 23 bp, Artificial Sequence
  Synthetic
ccgttttttttttttacctgcac

SEQ ID NO: 18054 - DNA, 23 bp, Artificial Sequence
  Synthetic
ccgttttttttttttcaccgaca

SEQ ID NO: 18055 - DNA, 23 bp, Artificial Sequence
  Synthetic
ccgttttttttttttacaatcaa

SEQ ID NO: 18056 - DNA, 23 bp, Artificial Sequence
  Synthetic
ccgttttttttttttcaccgaca

SEQ ID NO: 18057 - DNA, 23 bp, Artificial Sequence
  Synthetic
ccgttttttttttttcaccgaca

SEQ ID NO: 18058 - DNA, 23 bp, Artificial Sequence
  Synthetic
ccgttttttttttttcccaccga

SEQ ID NO: 18059 - DNA, 23 bp, Artificial Sequence
  Synthetic
ccgttttttttttttagttctac

SEQ ID NO: 18060 - DNA, 23 bp, Artificial Sequence
  Synthetic
ccgttttttttttttggcaagtc

SEQ ID NO: 18061 - DNA, 23 bp, Artificial Sequence
  Synthetic
ccgttttttttttttgtgaattc

SEQ ID NO: 18062 - DNA, 23 bp, Artificial Sequence
  Synthetic
ccgttttttttttttccttatca

SEQ ID NO: 18063 - DNA, 23 bp, Artificial Sequence
  Synthetic
ccgttttttttttttactgcctt

SEQ ID NO: 18064 - DNA, 23 bp, Artificial Sequence
  Synthetic
ccgttttttttttttgcccaaaa

SEQ ID NO: 18065 - DNA, 23 bp, Artificial Sequence
  Synthetic
ccgttttttttttttgctgcaac

SEQ ID NO: 18066 - DNA, 23 bp, Artificial Sequence
  Synthetic
ccgttttttttttttcctccacc

SEQ ID NO: 18067 - DNA, 23 bp, Artificial Sequence
  Synthetic
ccgttttttttttttgatatcag

SEQ ID NO: 18068 - DNA, 23 bp, Artificial Sequence
  Synthetic
ccgttttttttttttgcactaga

SEQ ID NO: 18069 - DNA, 23 bp, Artificial Sequence
  Synthetic
ccgttttttttttttaaggagca

SEQ ID NO: 18070 - DNA, 23 bp, Artificial Sequence
  Synthetic
ccgttttttttttttctgcacta

SEQ ID NO: 18071 - DNA, 23 bp, Artificial Sequence
  Synthetic
ccgttttttttttttctaatata

SEQ ID NO: 18072 - DNA, 23 bp, Artificial Sequence
  Synthetic
ccgttttttttttttctgctttt

SEQ ID NO: 18073 - DNA, 23 bp, Artificial Sequence
  Synthetic
ccgttttttttttttggacgaaa

SEQ ID NO: 18074 - DNA, 23 bp, Artificial Sequence
  Synthetic
ccgttttttttttttctgtcaat

SEQ ID NO: 18075 - DNA, 23 bp, Artificial Sequence
  Synthetic
ccgttttttttttttggactttg

SEQ ID NO: 18076 - DNA, 23 bp, Artificial Sequence
  Synthetic
ccgttttttttttttagcgggac

SEQ ID NO: 18077 - DNA, 23 bp, Artificial Sequence
  Synthetic
ccgttttttttttttacatggag

SEQ ID NO: 18078 - DNA, 23 bp, Artificial Sequence
  Synthetic
ccgttttttttttttcaatattt

SEQ ID NO: 18079 - DNA, 23 bp, Artificial Sequence
  Synthetic
ccgttttttttttttaacaacat

SEQ ID NO: 18080 - DNA, 23 bp, Artificial Sequence
  Synthetic
ccgttttttttttttaacaacag

SEQ ID NO: 18081 - DNA, 23 bp, Artificial Sequence
  Synthetic
ccgttttttttttttgggtggag

SEQ ID NO: 18082 - DNA, 23 bp, Artificial Sequence
  Synthetic
ccgttttttttttttatctcccc

SEQ ID NO: 18083 - DNA, 23 bp, Artificial Sequence
  Synthetic
ccgttttttttttttacaggtag

SEQ ID NO: 18084 - DNA, 23 bp, Artificial Sequence
  Synthetic
ccgttttttttttttccaatgtg

SEQ ID NO: 18085 - DNA, 23 bp, Artificial Sequence
  Synthetic
ccgttttttttttttacagatag

SEQ ID NO: 18086 - DNA, 23 bp, Artificial Sequence
  Synthetic
ccgttttttttttttgttttgca

SEQ ID NO: 18087 - DNA, 23 bp, Artificial Sequence
  Synthetic
ccgttttttttttttgttttgca

SEQ ID NO: 18088 - DNA, 23 bp, Artificial Sequence
  Synthetic
ccgttttttttttttatcgttac

SEQ ID NO: 18089 - DNA, 23 bp, Artificial Sequence
  Synthetic
ccgttttttttttttagcactgt

SEQ ID NO: 18090 - DNA, 23 bp, Artificial Sequence
  Synthetic
ccgttttttttttttatcattac

SEQ ID NO: 18091 - DNA, 23 bp, Artificial Sequence
  Synthetic
ccgttttttttttttatcattac

SEQ ID NO: 18092 - DNA, 23 bp, Artificial Sequence
  Synthetic
ccgttttttttttttcatgccct

SEQ ID NO: 18093 - DNA, 23 bp, Artificial Sequence
  Synthetic
ccgttttttttttttagaagtat

SEQ ID NO: 18094 - DNA, 23 bp, Artificial Sequence
  Synthetic
ccgttttttttttttgtggtcct

SEQ ID NO: 18095 - DNA, 23 bp, Artificial Sequence
  Synthetic
ccgttttttttttttgcatagga

SEQ ID NO: 18096 - DNA, 23 bp, Artificial Sequence
  Synthetic
ccgttttttttttttgactccgg

SEQ ID NO: 18097 - DNA, 23 bp, Artificial Sequence
  Synthetic
ccgttttttttttttacacactt

SEQ ID NO: 18098 - DNA, 23 bp, Artificial Sequence
  Synthetic
ccgttttttttttttaagctttt

SEQ ID NO: 18099 - DNA, 23 bp, Artificial Sequence
  Synthetic
ccgttttttttttttcctgcact

SEQ ID NO: 18100 - DNA, 23 bp, Artificial Sequence
  Synthetic
ccgttttttttttttcctgcact

SEQ ID NO: 18101 - DNA, 23 bp, Artificial Sequence
  Synthetic
ccgttttttttttttacatcagt

SEQ ID NO: 18102 - DNA, 23 bp, Artificial Sequence
  Synthetic
ccgttttttttttttgccgctgt

SEQ ID NO: 18103 - DNA, 23 bp, Artificial Sequence
  Synthetic
ccgttttttttttttgcgaagga

SEQ ID NO: 18104 - DNA, 23 bp, Artificial Sequence
  Synthetic
ccgttttttttttttccgtgact

SEQ ID NO: 18105 - DNA, 23 bp, Artificial Sequence
  Synthetic
ccgttttttttttttcctgtctg

SEQ ID NO: 18106 - DNA, 23 bp, Artificial Sequence
  Synthetic
ccgttttttttttttgtcaattc

SEQ ID NO: 18107 - DNA, 23 bp, Artificial Sequence
  Synthetic
ccgttttttttttttcagttgcc

SEQ ID NO: 18108 - DNA, 23 bp, Artificial Sequence
  Synthetic
ccgttttttttttttcaatcagt

SEQ ID NO: 18109 - DNA, 23 bp, Artificial Sequence
  Synthetic
ccgttttttttttttatggttag

SEQ ID NO: 18110 - DNA, 23 bp, Artificial Sequence
  Synthetic
ccgttttttttttttaattgcgt

SEQ ID NO: 18111 - DNA, 23 bp, Artificial Sequence
  Synthetic
ccgttttttttttttagttcttc

SEQ ID NO: 18112 - DNA, 23 bp, Artificial Sequence
  Synthetic
ccgttttttttttttagtgtcag

SEQ ID NO: 18113 - DNA, 23 bp, Artificial Sequence
  Synthetic
ccgttttttttttttaacccagc

SEQ ID NO: 18114 - DNA, 23 bp, Artificial Sequence
  Synthetic
ccgttttttttttttgacccagt

SEQ ID NO: 18115 - DNA, 23 bp, Artificial Sequence
  Synthetic
ccgttttttttttttggtatttg

SEQ ID NO: 18116 - DNA, 23 bp, Artificial Sequence
  Synthetic
ccgttttttttttttacggaacc

SEQ ID NO: 18117 - DNA, 23 bp, Artificial Sequence
  Synthetic
ccgttttttttttttaaatccct

SEQ ID NO: 18118 - DNA, 23 bp, Artificial Sequence
  Synthetic
ccgttttttttttttaatccctg

SEQ ID NO: 18119 - DNA, 23 bp, Artificial Sequence
  Synthetic
ccgttttttttttttcctgctga

SEQ ID NO: 18120 - DNA, 23 bp, Artificial Sequence
  Synthetic
ccgttttttttttttgaccgaga

SEQ ID NO: 18121 - DNA, 23 bp, Artificial Sequence
  Synthetic
ccgttttttttttttctatcctg

SEQ ID NO: 18122 - DNA, 23 bp, Artificial Sequence
  Synthetic
ccgttttttttttttcctatcct

SEQ ID NO: 18123 - DNA, 23 bp, Artificial Sequence
  Synthetic
ccgttttttttttttggaactta

SEQ ID NO: 18124 - DNA, 23 bp, Artificial Sequence
  Synthetic
ccgttttttttttttagaactta

SEQ ID NO: 18125 - DNA, 23 bp, Artificial Sequence
  Synthetic
ccgttttttttttttaatagact

SEQ ID NO: 18126 - DNA, 23 bp, Artificial Sequence
  Synthetic
ccgttttttttttttaggattga

SEQ ID NO: 18127 - DNA, 23 bp, Artificial Sequence
  Synthetic
ccgttttttttttttgcggttta

SEQ ID NO: 18128 - DNA, 23 bp, Artificial Sequence
  Synthetic
ccgttttttttttttatgtggga

SEQ ID NO: 18129 - DNA, 23 bp, Artificial Sequence
  Synthetic
ccgttttttttttttccgatttc

SEQ ID NO: 18130 - DNA, 23 bp, Artificial Sequence
  Synthetic
ccgttttttttttttcactgatt

SEQ ID NO: 18131 - DNA, 23 bp, Artificial Sequence
  Synthetic
ccgttttttttttttcgatttca

SEQ ID NO: 18132 - DNA, 23 bp, Artificial Sequence
  Synthetic
ccgttttttttttttgacaatac

SEQ ID NO: 18133 - DNA, 23 bp, Artificial Sequence
  Synthetic
ccgttttttttttttccaaaaca

SEQ ID NO: 18134 - DNA, 23 bp, Artificial Sequence
  Synthetic
ccgttttttttttttagcaagta

SEQ ID NO: 18135 - DNA, 23 bp, Artificial Sequence
  Synthetic
ccgttttttttttttctaaaaca

SEQ ID NO: 18136 - DNA, 23 bp, Artificial Sequence
  Synthetic
ccgttttttttttttaaagcact

SEQ ID NO: 18137 - DNA, 23 bp, Artificial Sequence
  Synthetic
ccgttttttttttttactgaaac

SEQ ID NO: 18138 - DNA, 23 bp, Artificial Sequence
  Synthetic
ccgttttttttttttgcaggtac

SEQ ID NO: 18139 - DNA, 23 bp, Artificial Sequence
  Synthetic
ccgttttttttttttactcaaac

SEQ ID NO: 18140 - DNA, 23 bp, Artificial Sequence
  Synthetic
ccgttttttttttttgcaaacat

SEQ ID NO: 18141 - DNA, 23 bp, Artificial Sequence
  Synthetic
ccgttttttttttttcagtcgag

SEQ ID NO: 18142 - DNA, 23 bp, Artificial Sequence
  Synthetic
ccgttttttttttttctgagtgt

SEQ ID NO: 18143 - DNA, 23 bp, Artificial Sequence
  Synthetic
ccgttttttttttttgagagtgt

SEQ ID NO: 18144 - DNA, 23 bp, Artificial Sequence
  Synthetic
ccgttttttttttttcagtcggg

SEQ ID NO: 18145 - DNA, 23 bp, Artificial Sequence
  Synthetic
ccgttttttttttttgtaaacat

SEQ ID NO: 18146 - DNA, 23 bp, Artificial Sequence
  Synthetic
ccgttttttttttttagtcaagg

SEQ ID NO: 18147 - DNA, 23 bp, Artificial Sequence
  Synthetic
ccgttttttttttttgctatgcc

SEQ ID NO: 18148 - DNA, 23 bp, Artificial Sequence
  Synthetic
ccgttttttttttttaacttagt

SEQ ID NO: 18149 - DNA, 23 bp, Artificial Sequence
  Synthetic
ccgttttttttttttccctctca

SEQ ID NO: 18150 - DNA, 23 bp, Artificial Sequence
  Synthetic
ccgttttttttttttaggtcgac

SEQ ID NO: 18151 - DNA, 23 bp, Artificial Sequence
  Synthetic
ccgttttttttttttagcagcac

SEQ ID NO: 18152 - DNA, 23 bp, Artificial Sequence
  Synthetic
ccgttttttttttttaccaatgc

SEQ ID NO: 18153 - DNA, 23 bp, Artificial Sequence
  Synthetic
ccgttttttttttttacttactg

SEQ ID NO: 18154 - DNA, 23 bp, Artificial Sequence
  Synthetic
ccgttttttttttttgaggaagg

SEQ ID NO: 18155 - DNA, 23 bp, Artificial Sequence
  Synthetic
ccgttttttttttttggaagggc

SEQ ID NO: 18156 - DNA, 23 bp, Artificial Sequence
  Synthetic
ccgttttttttttttagaggtta

SEQ ID NO: 18157 - DNA, 23 bp, Artificial Sequence
  Synthetic
ccgttttttttttttatgcaact

SEQ ID NO: 18158 - DNA, 23 bp, Artificial Sequence
  Synthetic
ccgttttttttttttgcaggccg

SEQ ID NO: 18159 - DNA, 23 bp, Artificial Sequence
  Synthetic
ccgttttttttttttggataggc

SEQ ID NO: 18160 - DNA, 23 bp, Artificial Sequence
  Synthetic
ccgttttttttttttatttttcg

SEQ ID NO: 18161 - DNA, 23 bp, Artificial Sequence
  Synthetic
ccgttttttttttttaggcatca

SEQ ID NO: 18162 - DNA, 23 bp, Artificial Sequence
  Synthetic
ccgttttttttttttacaaaatc

SEQ ID NO: 18163 - DNA, 23 bp, Artificial Sequence
  Synthetic
ccgttttttttttttgctcctgg

SEQ ID NO: 18164 - DNA, 23 bp, Artificial Sequence
  Synthetic
ccgttttttttttttaatgcaac

SEQ ID NO: 18165 - DNA, 23 bp, Artificial Sequence
  Synthetic
ccgttttttttttttctataaag

SEQ ID NO: 18166 - DNA, 23 bp, Artificial Sequence
  Synthetic
ccgttttttttttttcgggtgcg

SEQ ID NO: 18167 - DNA, 23 bp, Artificial Sequence
  Synthetic
ccgttttttttttttcctggact

SEQ ID NO: 18168 - DNA, 23 bp, Artificial Sequence
  Synthetic
ccgttttttttttttaggcaggc

SEQ ID NO: 18169 - DNA, 23 bp, Artificial Sequence
  Synthetic
ccgttttttttttttcaaccagc

SEQ ID NO: 18170 - DNA, 23 bp, Artificial Sequence
  Synthetic
ccgttttttttttttatcagcta

SEQ ID NO: 18171 - DNA, 23 bp, Artificial Sequence
  Synthetic
ccgttttttttttttaatcagct

SEQ ID NO: 18172 - DNA, 23 bp, Artificial Sequence
  Synthetic
ccgttttttttttttcccctgga

SEQ ID NO: 18173 - DNA, 23 bp, Artificial Sequence
  Synthetic
ccgttttttttttttcacaccta

SEQ ID NO: 18174 - DNA, 23 bp, Artificial Sequence
  Synthetic
ccgttttttttttttagatggat

SEQ ID NO: 18175 - DNA, 23 bp, Artificial Sequence
  Synthetic
ccgttttttttttttattgcatc

SEQ ID NO: 18176 - DNA, 23 bp, Artificial Sequence
  Synthetic
ccgttttttttttttaggatttt

SEQ ID NO: 18177 - DNA, 23 bp, Artificial Sequence
  Synthetic
ccgttttttttttttccattgct

SEQ ID NO: 18178 - DNA, 23 bp, Artificial Sequence
  Synthetic
ccgttttttttttttacgtggaa

SEQ ID NO: 18179 - DNA, 23 bp, Artificial Sequence
  Synthetic
ccgttttttttttttagatcaac

SEQ ID NO: 18180 - DNA, 23 bp, Artificial Sequence
  Synthetic
ccgttttttttttttgaatataa

SEQ ID NO: 18181 - DNA, 23 bp, Artificial Sequence
  Synthetic
ccgttttttttttttaggttcca

SEQ ID NO: 18182 - DNA, 23 bp, Artificial Sequence
  Synthetic
ccgttttttttttttactcaaaa

SEQ ID NO: 18183 - DNA, 23 bp, Artificial Sequence
  Synthetic
ccgttttttttttttgctcaaat

SEQ ID NO: 18184 - DNA, 23 bp, Artificial Sequence
  Synthetic
ccgttttttttttttaccccaaa

SEQ ID NO: 18185 - DNA, 23 bp, Artificial Sequence
  Synthetic
ccgttttttttttttaaagcgcc

SEQ ID NO: 18186 - DNA, 23 bp, Artificial Sequence
  Synthetic
ccgttttttttttttcttatcag

SEQ ID NO: 18187 - DNA, 23 bp, Artificial Sequence
  Synthetic
ccgttttttttttttcgcgagcc

SEQ ID NO: 18188 - DNA, 23 bp, Artificial Sequence
  Synthetic
ccgttttttttttttgtggattt

SEQ ID NO: 18189 - DNA, 23 bp, Artificial Sequence
  Synthetic
ccgttttttttttttatagaagg

SEQ ID NO: 18190 - DNA, 23 bp, Artificial Sequence
  Synthetic
ccgttttttttttttcatggatt

SEQ ID NO: 18191 - DNA, 23 bp, Artificial Sequence
  Synthetic
ccgttttttttttttaaaagttg

SEQ ID NO: 18192 - DNA, 23 bp, Artificial Sequence
  Synthetic
ccgttttttttttttacaggacc

SEQ ID NO: 18193 - DNA, 23 bp, Artificial Sequence
  Synthetic
ccgttttttttttttgttccata

SEQ ID NO: 18194 - DNA, 23 bp, Artificial Sequence
  Synthetic
ccgttttttttttttgatgtgga

SEQ ID NO: 18195 - DNA, 23 bp, Artificial Sequence
  Synthetic
ccgttttttttttttgcatgttc

SEQ ID NO: 18196 - DNA, 23 bp, Artificial Sequence
  Synthetic
ccgttttttttttttagagagct

SEQ ID NO: 18197 - DNA, 23 bp, Artificial Sequence
  Synthetic
ccgttttttttttttaatccacc

SEQ ID NO: 18198 - DNA, 23 bp, Artificial Sequence
  Synthetic
ccgttttttttttttccacaatc

SEQ ID NO: 18199 - DNA, 23 bp, Artificial Sequence
  Synthetic
ccgttttttttttttaacaattt

SEQ ID NO: 18200 - DNA, 23 bp, Artificial Sequence
  Synthetic
ccgttttttttttttgggttcac

SEQ ID NO: 18201 - DNA, 23 bp, Artificial Sequence
  Synthetic
ccgttttttttttttaaagttgc

SEQ ID NO: 18202 - DNA, 23 bp, Artificial Sequence
  Synthetic
ccgttttttttttttaggccatc

SEQ ID NO: 18203 - DNA, 23 bp, Artificial Sequence
  Synthetic
ccgttttttttttttacgctata

SEQ ID NO: 18204 - DNA, 23 bp, Artificial Sequence
  Synthetic
ccgttttttttttttggctagtg

SEQ ID NO: 18205 - DNA, 23 bp, Artificial Sequence
  Synthetic
ccgttttttttttttgcccaatt

SEQ ID NO: 18206 - DNA, 23 bp, Artificial Sequence
  Synthetic
ccgttttttttttttccttctga

SEQ ID NO: 18207 - DNA, 23 bp, Artificial Sequence
  Synthetic
ccgttttttttttttccttctga

SEQ ID NO: 18208 - DNA, 23 bp, Artificial Sequence
  Synthetic
ccgttttttttttttaggggcct

SEQ ID NO: 18209 - DNA, 23 bp, Artificial Sequence
  Synthetic
ccgttttttttttttaaacatga

SEQ ID NO: 18210 - DNA, 23 bp, Artificial Sequence
  Synthetic
ccgttttttttttttcggacacg

SEQ ID NO: 18211 - DNA, 23 bp, Artificial Sequence
  Synthetic
ccgttttttttttttacgggagt

SEQ ID NO: 18212 - DNA, 23 bp, Artificial Sequence
  Synthetic
ccgttttttttttttggttttac

SEQ ID NO: 18213 - DNA, 23 bp, Artificial Sequence
  Synthetic
ccgttttttttttttatgacggc

SEQ ID NO: 18214 - DNA, 23 bp, Artificial Sequence
  Synthetic
ccgttttttttttttacccaatg

SEQ ID NO: 18215 - DNA, 23 bp, Artificial Sequence
  Synthetic
ccgttttttttttttacatggag

SEQ ID NO: 18216 - DNA, 23 bp, Artificial Sequence
  Synthetic
ccgttttttttttttaccgagga

SEQ ID NO: 18217 - DNA, 23 bp, Artificial Sequence
  Synthetic
ccgttttttttttttggacatcc

SEQ ID NO: 18218 - DNA, 23 bp, Artificial Sequence
  Synthetic
ccgttttttttttttcagctaac

SEQ ID NO: 18219 - DNA, 23 bp, Artificial Sequence
  Synthetic
ccgttttttttttttcagctaac

SEQ ID NO: 18220 - DNA, 23 bp, Artificial Sequence
  Synthetic
ccgttttttttttttggaacaca

SEQ ID NO: 18221 - DNA, 23 bp, Artificial Sequence
  Synthetic
ccgttttttttttttactcagta

SEQ ID NO: 18222 - DNA, 23 bp, Artificial Sequence
  Synthetic
ccgttttttttttttcagtttcc

SEQ ID NO: 18223 - DNA, 23 bp, Artificial Sequence
  Synthetic
ccgttttttttttttgcagatga

SEQ ID NO: 18224 - DNA, 23 bp, Artificial Sequence
  Synthetic
ccgttttttttttttaactcacc

SEQ ID NO: 18225 - DNA, 23 bp, Artificial Sequence
  Synthetic
ccgttttttttttttaccctata

SEQ ID NO: 18226 - DNA, 23 bp, Artificial Sequence
  Synthetic
ccgttttttttttttagagacaa

SEQ ID NO: 18227 - DNA, 23 bp, Artificial Sequence
  Synthetic
ccgttttttttttttatgtagtc

SEQ ID NO: 18228 - DNA, 23 bp, Artificial Sequence
  Synthetic
ccgttttttttttttaagacggg

SEQ ID NO: 18229 - DNA, 23 bp, Artificial Sequence
  Synthetic
ccgttttttttttttgggagggg

SEQ ID NO: 18230 - DNA, 23 bp, Artificial Sequence
  Synthetic
ccgttttttttttttagaggaga

SEQ ID NO: 18231 - DNA, 23 bp, Artificial Sequence
  Synthetic
ccgttttttttttttattcatca

SEQ ID NO: 18232 - DNA, 23 bp, Artificial Sequence
  Synthetic
ccgttttttttttttggggcagc

SEQ ID NO: 18233 - DNA, 23 bp, Artificial Sequence
  Synthetic
ccgttttttttttttctggatgt

SEQ ID NO: 18234 - DNA, 23 bp, Artificial Sequence
  Synthetic
ccgttttttttttttgtggatga

SEQ ID NO: 18235 - DNA, 23 bp, Artificial Sequence
  Synthetic
ccgttttttttttttgagtgcca

SEQ ID NO: 18236 - DNA, 23 bp, Artificial Sequence
  Synthetic
ccgttttttttttttgccgtata

SEQ ID NO: 18237 - DNA, 23 bp, Artificial Sequence
  Synthetic
ccgttttttttttttgcatggag

SEQ ID NO: 18238 - DNA, 23 bp, Artificial Sequence
  Synthetic
ccgttttttttttttcatggaag

SEQ ID NO: 18239 - DNA, 23 bp, Artificial Sequence
  Synthetic
ccgttttttttttttgaatcttg

SEQ ID NO: 18240 - DNA, 23 bp, Artificial Sequence
  Synthetic
ccgttttttttttttgcacacag

SEQ ID NO: 18241 - DNA, 23 bp, Artificial Sequence
  Synthetic
ccgttttttttttttgaaagcct

SEQ ID NO: 18242 - DNA, 23 bp, Artificial Sequence
  Synthetic
ccgttttttttttttgaggtttc

SEQ ID NO: 18243 - DNA, 23 bp, Artificial Sequence
  Synthetic
ccgttttttttttttagaagtgc

SEQ ID NO: 18244 - DNA, 23 bp, Artificial Sequence
  Synthetic
ccgttttttttttttgattggcc

SEQ ID NO: 18245 - DNA, 23 bp, Artificial Sequence
  Synthetic
ccgttttttttttttaaaccaca

SEQ ID NO: 18246 - DNA, 23 bp, Artificial Sequence
  Synthetic
ccgttttttttttttaaaacgcc

SEQ ID NO: 18247 - DNA, 23 bp, Artificial Sequence
  Synthetic
ccgttttttttttttacatcact

SEQ ID NO: 18248 - DNA, 23 bp, Artificial Sequence
  Synthetic
ccgttttttttttttgaatcctt

SEQ ID NO: 18249 - DNA, 23 bp, Artificial Sequence
  Synthetic
ccgttttttttttttacccaggg

SEQ ID NO: 18250 - DNA, 23 bp, Artificial Sequence
  Synthetic
ccgttttttttttttcacccaga

SEQ ID NO: 18251 - DNA, 23 bp, Artificial Sequence
  Synthetic
ccgttttttttttttcagaactg

SEQ ID NO: 18252 - DNA, 23 bp, Artificial Sequence
  Synthetic
ccgttttttttttttgagtgcag

SEQ ID NO: 18253 - DNA, 23 bp, Artificial Sequence
  Synthetic
ccgttttttttttttggaaacca

SEQ ID NO: 18254 - DNA, 23 bp, Artificial Sequence
  Synthetic
ccgttttttttttttctcagaag

SEQ ID NO: 18255 - DNA, 23 bp, Artificial Sequence
  Synthetic
ccgttttttttttttctccaaaa

SEQ ID NO: 18256 - DNA, 23 bp, Artificial Sequence
  Synthetic
ccgttttttttttttctccaaaa

SEQ ID NO: 18257 - DNA, 23 bp, Artificial Sequence
  Synthetic
ccgttttttttttttcccacaga

SEQ ID NO: 18258 - DNA, 23 bp, Artificial Sequence
  Synthetic
ccgttttttttttttattgccac

SEQ ID NO: 18259 - DNA, 23 bp, Artificial Sequence
  Synthetic
ccgttttttttttttctgcagag

SEQ ID NO: 18260 - DNA, 23 bp, Artificial Sequence
  Synthetic
ccgttttttttttttcctcagct

SEQ ID NO: 18261 - DNA, 23 bp, Artificial Sequence
  Synthetic
ccgttttttttttttaagtgccc

SEQ ID NO: 18262 - DNA, 23 bp, Artificial Sequence
  Synthetic
ccgttttttttttttaatgacac

SEQ ID NO: 18263 - DNA, 23 bp, Artificial Sequence
  Synthetic
ccgttttttttttttctcacaga

SEQ ID NO: 18264 - DNA, 23 bp, Artificial Sequence
  Synthetic
ccgttttttttttttgctccaaa

SEQ ID NO: 18265 - DNA, 23 bp, Artificial Sequence
  Synthetic
ccgttttttttttttgaaagtgc

SEQ ID NO: 18266 - DNA, 23 bp, Artificial Sequence
  Synthetic
ccgttttttttttttcctctgaa

SEQ ID NO: 18267 - DNA, 23 bp, Artificial Sequence
  Synthetic
ccgttttttttttttagtgcttc

SEQ ID NO: 18268 - DNA, 23 bp, Artificial Sequence
  Synthetic
ccgttttttttttttacagtgct

SEQ ID NO: 18269 - DNA, 23 bp, Artificial Sequence
  Synthetic
ccgttttttttttttcactctaa

SEQ ID NO: 18270 - DNA, 23 bp, Artificial Sequence
  Synthetic
ccgttttttttttttcactctaa

SEQ ID NO: 18271 - DNA, 23 bp, Artificial Sequence
  Synthetic
ccgttttttttttttactctaaa

SEQ ID NO: 18272 - DNA, 23 bp, Artificial Sequence
  Synthetic
ccgttttttttttttagcaaagg

SEQ ID NO: 18273 - DNA, 23 bp, Artificial Sequence
  Synthetic
ccgttttttttttttctctaaag

SEQ ID NO: 18274 - DNA, 23 bp, Artificial Sequence
  Synthetic
ccgttttttttttttctctaaag

SEQ ID NO: 18275 - DNA, 23 bp, Artificial Sequence
  Synthetic
ccgttttttttttttgaaagtgc

SEQ ID NO: 18276 - DNA, 23 bp, Artificial Sequence
  Synthetic
ccgttttttttttttccaaaggg

SEQ ID NO: 18277 - DNA, 23 bp, Artificial Sequence
  Synthetic
ccgttttttttttttactctgaa

SEQ ID NO: 18278 - DNA, 23 bp, Artificial Sequence
  Synthetic
ccgttttttttttttctaaagag

SEQ ID NO: 18279 - DNA, 23 bp, Artificial Sequence
  Synthetic
ccgttttttttttttagaaagtg

SEQ ID NO: 18280 - DNA, 23 bp, Artificial Sequence
  Synthetic
ccgttttttttttttacactcta

SEQ ID NO: 18281 - DNA, 23 bp, Artificial Sequence
  Synthetic
ccgttttttttttttacctctaa

SEQ ID NO: 18282 - DNA, 23 bp, Artificial Sequence
  Synthetic
ccgttttttttttttctctaaaa

SEQ ID NO: 18283 - DNA, 23 bp, Artificial Sequence
  Synthetic
ccgttttttttttttactctaaa

SEQ ID NO: 18284 - DNA, 23 bp, Artificial Sequence
  Synthetic
ccgttttttttttttactctaaa

SEQ ID NO: 18285 - DNA, 23 bp, Artificial Sequence
  Synthetic
ccgttttttttttttaagtgctc

SEQ ID NO: 18286 - DNA, 23 bp, Artificial Sequence
  Synthetic
ccgttttttttttttagtccaaa

SEQ ID NO: 18287 - DNA, 23 bp, Artificial Sequence
  Synthetic
ccgttttttttttttaaagtact

SEQ ID NO: 18288 - DNA, 23 bp, Artificial Sequence
  Synthetic
ccgttttttttttttctctaaaa

SEQ ID NO: 18289 - DNA, 23 bp, Artificial Sequence
  Synthetic
ccgttttttttttttccctctaa

SEQ ID NO: 18290 - DNA, 23 bp, Artificial Sequence
  Synthetic
ccgttttttttttttcccaccaa

SEQ ID NO: 18291 - DNA, 23 bp, Artificial Sequence
  Synthetic
ccgttttttttttttgaaagggc

SEQ ID NO: 18292 - DNA, 23 bp, Artificial Sequence
  Synthetic
ccgttttttttttttctcaaaaa

SEQ ID NO: 18293 - DNA, 23 bp, Artificial Sequence
  Synthetic
ccgttttttttttttccctctaa

SEQ ID NO: 18294 - DNA, 23 bp, Artificial Sequence
  Synthetic
ccgttttttttttttactctaaa

SEQ ID NO: 18295 - DNA, 23 bp, Artificial Sequence
  Synthetic
ccgttttttttttttctaaaggg

SEQ ID NO: 18296 - DNA, 23 bp, Artificial Sequence
  Synthetic
ccgttttttttttttactctaaa

SEQ ID NO: 18297 - DNA, 23 bp, Artificial Sequence
  Synthetic
ccgttttttttttttcactctaa

SEQ ID NO: 18298 - DNA, 23 bp, Artificial Sequence
  Synthetic
ccgttttttttttttctctatag

SEQ ID NO: 18299 - DNA, 23 bp, Artificial Sequence
  Synthetic
ccgttttttttttttccaaaggg

SEQ ID NO: 18300 - DNA, 23 bp, Artificial Sequence
  Synthetic
ccgttttttttttttgaaagtgc

SEQ ID NO: 18301 - DNA, 23 bp, Artificial Sequence
  Synthetic
ccgttttttttttttaaagtgca

SEQ ID NO: 18302 - DNA, 23 bp, Artificial Sequence
  Synthetic
ccgttttttttttttctaaaggg

SEQ ID NO: 18303 - DNA, 23 bp, Artificial Sequence
  Synthetic
ccgttttttttttttaaagtgct

SEQ ID NO: 18304 - DNA, 23 bp, Artificial Sequence
  Synthetic
ccgttttttttttttcagaaagt

SEQ ID NO: 18305 - DNA, 23 bp, Artificial Sequence
  Synthetic
ccgttttttttttttctctaaaa

SEQ ID NO: 18306 - DNA, 23 bp, Artificial Sequence
  Synthetic
ccgttttttttttttcagaaagc

SEQ ID NO: 18307 - DNA, 23 bp, Artificial Sequence
  Synthetic
ccgttttttttttttaaagggct

SEQ ID NO: 18308 - DNA, 23 bp, Artificial Sequence
  Synthetic
ccgttttttttttttggtcctac

SEQ ID NO: 18309 - DNA, 23 bp, Artificial Sequence
  Synthetic
ccgttttttttttttacaccaag

SEQ ID NO: 18310 - DNA, 23 bp, Artificial Sequence
  Synthetic
ccgttttttttttttgttatcaa

SEQ ID NO: 18311 - DNA, 23 bp, Artificial Sequence
  Synthetic
ccgttttttttttttgtgacatg

SEQ ID NO: 18312 - DNA, 23 bp, Artificial Sequence
  Synthetic
ccgttttttttttttgctaaaaa

SEQ ID NO: 18313 - DNA, 23 bp, Artificial Sequence
  Synthetic
ccgttttttttttttcacaataa

SEQ ID NO: 18314 - DNA, 23 bp, Artificial Sequence
  Synthetic
ccgttttttttttttaaaagtaa

SEQ ID NO: 18315 - DNA, 23 bp, Artificial Sequence
  Synthetic
ccgttttttttttttaaaagcaa

SEQ ID NO: 18316 - DNA, 23 bp, Artificial Sequence
  Synthetic
ccgttttttttttttaaaagtaa

SEQ ID NO: 18317 - DNA, 23 bp, Artificial Sequence
  Synthetic
ccgttttttttttttaaaagaaa

SEQ ID NO: 18318 - DNA, 23 bp, Artificial Sequence
  Synthetic
ccgttttttttttttagctcatc

SEQ ID NO: 18319 - DNA, 23 bp, Artificial Sequence
  Synthetic
ccgttttttttttttgcctgagg

SEQ ID NO: 18320 - DNA, 23 bp, Artificial Sequence
  Synthetic
ccgttttttttttttaaaccaag

SEQ ID NO: 18321 - DNA, 23 bp, Artificial Sequence
  Synthetic
ccgttttttttttttaaaccaag

SEQ ID NO: 18322 - DNA, 23 bp, Artificial Sequence
  Synthetic
ccgttttttttttttaaccagtc

SEQ ID NO: 18323 - DNA, 23 bp, Artificial Sequence
  Synthetic
ccgttttttttttttaacaaaat

SEQ ID NO: 18324 - DNA, 23 bp, Artificial Sequence
  Synthetic
ccgttttttttttttggctgagt

SEQ ID NO: 18325 - DNA, 23 bp, Artificial Sequence
  Synthetic
ccgttttttttttttagaggttc

SEQ ID NO: 18326 - DNA, 23 bp, Artificial Sequence
  Synthetic
ccgttttttttttttattacaat

SEQ ID NO: 18327 - DNA, 23 bp, Artificial Sequence
  Synthetic
ccgttttttttttttacaaggcc

SEQ ID NO: 18328 - DNA, 23 bp, Artificial Sequence
  Synthetic
ccgttttttttttttgtacagca

SEQ ID NO: 18329 - DNA, 23 bp, Artificial Sequence
  Synthetic
ccgttttttttttttgcatattt

SEQ ID NO: 18330 - DNA, 23 bp, Artificial Sequence
  Synthetic
ccgttttttttttttcggccggc

SEQ ID NO: 18331 - DNA, 23 bp, Artificial Sequence
  Synthetic
ccgttttttttttttcaaggatc

SEQ ID NO: 18332 - DNA, 23 bp, Artificial Sequence
  Synthetic
ccgttttttttttttaaatggta

SEQ ID NO: 18333 - DNA, 23 bp, Artificial Sequence
  Synthetic
ccgttttttttttttgaaacgta

SEQ ID NO: 18334 - DNA, 23 bp, Artificial Sequence
  Synthetic
ccgttttttttttttctgctgac

SEQ ID NO: 18335 - DNA, 23 bp, Artificial Sequence
  Synthetic
ccgttttttttttttacagacat

SEQ ID NO: 18336 - DNA, 23 bp, Artificial Sequence
  Synthetic
ccgttttttttttttggatcaca

SEQ ID NO: 18337 - DNA, 23 bp, Artificial Sequence
  Synthetic
ccgttttttttttttgtcctgga

SEQ ID NO: 18338 - DNA, 23 bp, Artificial Sequence
  Synthetic
ccgttttttttttttgtatacat

SEQ ID NO: 18339 - DNA, 23 bp, Artificial Sequence
  Synthetic
ccgttttttttttttccaggatt

SEQ ID NO: 18340 - DNA, 23 bp, Artificial Sequence
  Synthetic
ccgttttttttttttaaaggtaa

SEQ ID NO: 18341 - DNA, 23 bp, Artificial Sequence
  Synthetic
ccgttttttttttttactcagat

SEQ ID NO: 18342 - DNA, 23 bp, Artificial Sequence
  Synthetic
ccgttttttttttttgccaccgc

SEQ ID NO: 18343 - DNA, 23 bp, Artificial Sequence
  Synthetic
ccgttttttttttttatcagtta

SEQ ID NO: 18344 - DNA, 23 bp, Artificial Sequence
  Synthetic
ccgttttttttttttggtgtgtg

SEQ ID NO: 18345 - DNA, 23 bp, Artificial Sequence
  Synthetic
ccgttttttttttttcctgtcca

SEQ ID NO: 18346 - DNA, 23 bp, Artificial Sequence
  Synthetic
ccgttttttttttttaagacgtg

SEQ ID NO: 18347 - DNA, 23 bp, Artificial Sequence
  Synthetic
ccgttttttttttttggtaccaa

SEQ ID NO: 18348 - DNA, 23 bp, Artificial Sequence
  Synthetic
ccgttttttttttttaatcctag

SEQ ID NO: 18349 - DNA, 23 bp, Artificial Sequence
  Synthetic
ccgttttttttttttgcggttta

SEQ ID NO: 18350 - DNA, 23 bp, Artificial Sequence
  Synthetic
ccgttttttttttttaatgattc

SEQ ID NO: 18351 - DNA, 23 bp, Artificial Sequence
  Synthetic
ccgttttttttttttgatctaga

SEQ ID NO: 18352 - DNA, 23 bp, Artificial Sequence
  Synthetic
ccgttttttttttttaactggtt

SEQ ID NO: 18353 - DNA, 23 bp, Artificial Sequence
  Synthetic
ccgttttttttttttatgggacc

SEQ ID NO: 18354 - DNA, 23 bp, Artificial Sequence
  Synthetic
ccgttttttttttttagtcccag

SEQ ID NO: 18355 - DNA, 23 bp, Artificial Sequence
  Synthetic
ccgttttttttttttcatacaga

SEQ ID NO: 18356 - DNA, 23 bp, Artificial Sequence
  Synthetic
ccgttttttttttttacctaaaa

SEQ ID NO: 18357 - DNA, 23 bp, Artificial Sequence
  Synthetic
ccgttttttttttttactcatca

SEQ ID NO: 18358 - DNA, 23 bp, Artificial Sequence
  Synthetic
ccgttttttttttttaacccatt

SEQ ID NO: 18359 - DNA, 23 bp, Artificial Sequence
  Synthetic
ccgttttttttttttggaaccgg

SEQ ID NO: 18360 - DNA, 23 bp, Artificial Sequence
  Synthetic
ccgttttttttttttcactttta

SEQ ID NO: 18361 - DNA, 23 bp, Artificial Sequence
  Synthetic
ccgttttttttttttaatgagaa

SEQ ID NO: 18362 - DNA, 23 bp, Artificial Sequence
  Synthetic
ccgttttttttttttatcatcgc

SEQ ID NO: 18363 - DNA, 23 bp, Artificial Sequence
  Synthetic
ccgttttttttttttgagcaatg

SEQ ID NO: 18364 - DNA, 23 bp, Artificial Sequence
  Synthetic
ccgttttttttttttagtcacag

SEQ ID NO: 18365 - DNA, 23 bp, Artificial Sequence
  Synthetic
ccgttttttttttttacacacca

SEQ ID NO: 18366 - DNA, 23 bp, Artificial Sequence
  Synthetic
ccgttttttttttttcgaggagc

SEQ ID NO: 18367 - DNA, 23 bp, Artificial Sequence
  Synthetic
ccgttttttttttttagtggtca

SEQ ID NO: 18368 - DNA, 23 bp, Artificial Sequence
  Synthetic
ccgttttttttttttcgatgaca

SEQ ID NO: 18369 - DNA, 23 bp, Artificial Sequence
  Synthetic
ccgttttttttttttataaactg

SEQ ID NO: 18370 - DNA, 23 bp, Artificial Sequence
  Synthetic
ccgttttttttttttgcaaggct

SEQ ID NO: 18371 - DNA, 23 bp, Artificial Sequence
  Synthetic
ccgttttttttttttctccaaca

SEQ ID NO: 18372 - DNA, 23 bp, Artificial Sequence
  Synthetic
ccgttttttttttttgccgcagc

SEQ ID NO: 18373 - DNA, 23 bp, Artificial Sequence
  Synthetic
ccgttttttttttttaaaagtaa

SEQ ID NO: 18374 - DNA, 23 bp, Artificial Sequence
  Synthetic
ccgttttttttttttctgaattc

SEQ ID NO: 18375 - DNA, 23 bp, Artificial Sequence
  Synthetic
ccgttttttttttttgagaaggc

SEQ ID NO: 18376 - DNA, 23 bp, Artificial Sequence
  Synthetic
ccgttttttttttttgattttca

SEQ ID NO: 18377 - DNA, 23 bp, Artificial Sequence
  Synthetic
ccgttttttttttttagatctgg

SEQ ID NO: 18378 - DNA, 23 bp, Artificial Sequence
  Synthetic
ccgttttttttttttggagctgt

SEQ ID NO: 18379 - DNA, 23 bp, Artificial Sequence
  Synthetic
ccgttttttttttttagatgaga

SEQ ID NO: 18380 - DNA, 23 bp, Artificial Sequence
  Synthetic
ccgttttttttttttcagcacac

SEQ ID NO: 18381 - DNA, 23 bp, Artificial Sequence
  Synthetic
ccgttttttttttttagaccccg

SEQ ID NO: 18382 - DNA, 23 bp, Artificial Sequence
  Synthetic
ccgttttttttttttggagctca

SEQ ID NO: 18383 - DNA, 23 bp, Artificial Sequence
  Synthetic
ccgttttttttttttcaaagaag

SEQ ID NO: 18384 - DNA, 23 bp, Artificial Sequence
  Synthetic
ccgttttttttttttacctggca

SEQ ID NO: 18385 - DNA, 23 bp, Artificial Sequence
  Synthetic
ccgttttttttttttagggagac

SEQ ID NO: 18386 - DNA, 23 bp, Artificial Sequence
  Synthetic
ccgttttttttttttgtcactga

SEQ ID NO: 18387 - DNA, 23 bp, Artificial Sequence
  Synthetic
ccgttttttttttttcaccttca

SEQ ID NO: 18388 - DNA, 23 bp, Artificial Sequence
  Synthetic
ccgttttttttttttcagaagga

SEQ ID NO: 18389 - DNA, 23 bp, Artificial Sequence
  Synthetic
ccgttttttttttttgggcacaa

SEQ ID NO: 18390 - DNA, 23 bp, Artificial Sequence
  Synthetic
ccgttttttttttttatatctat

SEQ ID NO: 18391 - DNA, 23 bp, Artificial Sequence
  Synthetic
ccgttttttttttttgtaagcgc

SEQ ID NO: 18392 - DNA, 23 bp, Artificial Sequence
  Synthetic
ccgttttttttttttccaacctc

SEQ ID NO: 18393 - DNA, 23 bp, Artificial Sequence
  Synthetic
ccgttttttttttttccaacagc

SEQ ID NO: 18394 - DNA, 23 bp, Artificial Sequence
  Synthetic
ccgttttttttttttacacaagg

SEQ ID NO: 18395 - DNA, 23 bp, Artificial Sequence
  Synthetic
ccgttttttttttttgactatag

SEQ ID NO: 18396 - DNA, 23 bp, Artificial Sequence
  Synthetic
ccgttttttttttttgacatttt

SEQ ID NO: 18397 - DNA, 23 bp, Artificial Sequence
  Synthetic
ccgttttttttttttcttttctt

SEQ ID NO: 18398 - DNA, 23 bp, Artificial Sequence
  Synthetic
ccgttttttttttttactgccac

SEQ ID NO: 18399 - DNA, 23 bp, Artificial Sequence
  Synthetic
ccgttttttttttttgggcttac

SEQ ID NO: 18400 - DNA, 23 bp, Artificial Sequence
  Synthetic
ccgttttttttttttcttccctg

SEQ ID NO: 18401 - DNA, 23 bp, Artificial Sequence
  Synthetic
ccgttttttttttttgaggtctg

SEQ ID NO: 18402 - DNA, 23 bp, Artificial Sequence
  Synthetic
ccgttttttttttttcacaggaa

SEQ ID NO: 18403 - DNA, 23 bp, Artificial Sequence
  Synthetic
ccgttttttttttttggtagata

SEQ ID NO: 18404 - DNA, 23 bp, Artificial Sequence
  Synthetic
ccgttttttttttttcaaagttg

SEQ ID NO: 18405 - DNA, 23 bp, Artificial Sequence
  Synthetic
ccgttttttttttttacattgtt

SEQ ID NO: 18406 - DNA, 23 bp, Artificial Sequence
  Synthetic
ccgttttttttttttcgggcggg

SEQ ID NO: 18407 - DNA, 23 bp, Artificial Sequence
  Synthetic
ccgttttttttttttgcagagcc

SEQ ID NO: 18408 - DNA, 23 bp, Artificial Sequence
  Synthetic
ccgttttttttttttgccgccac

SEQ ID NO: 18409 - DNA, 23 bp, Artificial Sequence
  Synthetic
ccgttttttttttttagcgctcg

SEQ ID NO: 18410 - DNA, 23 bp, Artificial Sequence
  Synthetic
ccgttttttttttttaggcaggt

SEQ ID NO: 18411 - DNA, 23 bp, Artificial Sequence
  Synthetic
ccgttttttttttttggtgactc

SEQ ID NO: 18412 - DNA, 23 bp, Artificial Sequence
  Synthetic
ccgttttttttttttagacacat

SEQ ID NO: 18413 - DNA, 23 bp, Artificial Sequence
  Synthetic
ccgttttttttttttcctgagct

SEQ ID NO: 18414 - DNA, 23 bp, Artificial Sequence
  Synthetic
ccgttttttttttttctaagaaa

SEQ ID NO: 18415 - DNA, 23 bp, Artificial Sequence
  Synthetic
ccgttttttttttttgcagtacc

SEQ ID NO: 18416 - DNA, 23 bp, Artificial Sequence
  Synthetic
ccgttttttttttttctcagagg

SEQ ID NO: 18417 - DNA, 23 bp, Artificial Sequence
  Synthetic
ccgttttttttttttaggaagtg

SEQ ID NO: 18418 - DNA, 23 bp, Artificial Sequence
  Synthetic
ccgttttttttttttcagtgccc

SEQ ID NO: 18419 - DNA, 23 bp, Artificial Sequence
  Synthetic
ccgttttttttttttctcttgaa

SEQ ID NO: 18420 - DNA, 23 bp, Artificial Sequence
  Synthetic
ccgttttttttttttctgagagc

SEQ ID NO: 18421 - DNA, 23 bp, Artificial Sequence
  Synthetic
ccgttttttttttttaaagtcaa

SEQ ID NO: 18422 - DNA, 23 bp, Artificial Sequence
  Synthetic
ccgttttttttttttacaaccct

SEQ ID NO: 18423 - DNA, 23 bp, Artificial Sequence
  Synthetic
ccgttttttttttttagtagaga

SEQ ID NO: 18424 - DNA, 23 bp, Artificial Sequence
  Synthetic
ccgttttttttttttacatgttc

SEQ ID NO: 18425 - DNA, 23 bp, Artificial Sequence
  Synthetic
ccgttttttttttttagaggtta

SEQ ID NO: 18426 - DNA, 23 bp, Artificial Sequence
  Synthetic
ccgttttttttttttaggttgac

SEQ ID NO: 18427 - DNA, 23 bp, Artificial Sequence
  Synthetic
ccgttttttttttttagagaggg

SEQ ID NO: 18428 - DNA, 23 bp, Artificial Sequence
  Synthetic
ccgttttttttttttcaacggac

SEQ ID NO: 18429 - DNA, 23 bp, Artificial Sequence
  Synthetic
ccgttttttttttttggaccctc

SEQ ID NO: 18430 - DNA, 23 bp, Artificial Sequence
  Synthetic
ccgttttttttttttactccgat

SEQ ID NO: 18431 - DNA, 23 bp, Artificial Sequence
  Synthetic
ccgttttttttttttgcgcaggc

SEQ ID NO: 18432 - DNA, 23 bp, Artificial Sequence
  Synthetic
ccgttttttttttttctgggcca

SEQ ID NO: 18433 - DNA, 23 bp, Artificial Sequence
  Synthetic
ccgttttttttttttggtcccgc

SEQ ID NO: 18434 - DNA, 23 bp, Artificial Sequence
  Synthetic
ccgttttttttttttgtgggccg

SEQ ID NO: 18435 - DNA, 23 bp, Artificial Sequence
  Synthetic
ccgttttttttttttctccagcc

SEQ ID NO: 18436 - DNA, 23 bp, Artificial Sequence
  Synthetic
ccgttttttttttttacaaaatc

SEQ ID NO: 18437 - DNA, 23 bp, Artificial Sequence
  Synthetic
ccgttttttttttttagtggacc

SEQ ID NO: 18438 - DNA, 23 bp, Artificial Sequence
  Synthetic
ccgttttttttttttcaccttcc

SEQ ID NO: 18439 - DNA, 23 bp, Artificial Sequence
  Synthetic
ccgttttttttttttgaggctgt

SEQ ID NO: 18440 - DNA, 23 bp, Artificial Sequence
  Synthetic
ccgttttttttttttaaaccatg

SEQ ID NO: 18441 - DNA, 23 bp, Artificial Sequence
  Synthetic
ccgttttttttttttgctcagac

SEQ ID NO: 18442 - DNA, 23 bp, Artificial Sequence
  Synthetic
ccgttttttttttttagcagttt

SEQ ID NO: 18443 - DNA, 23 bp, Artificial Sequence
  Synthetic
ccgttttttttttttactccgta

SEQ ID NO: 18444 - DNA, 23 bp, Artificial Sequence
  Synthetic
ccgttttttttttttccaagacc

SEQ ID NO: 18445 - DNA, 23 bp, Artificial Sequence
  Synthetic
ccgttttttttttttctcagaac

SEQ ID NO: 18446 - DNA, 23 bp, Artificial Sequence
  Synthetic
ccgttttttttttttccctgaca

SEQ ID NO: 18447 - DNA, 23 bp, Artificial Sequence
  Synthetic
ccgttttttttttttgattccgc

SEQ ID NO: 18448 - DNA, 23 bp, Artificial Sequence
  Synthetic
ccgttttttttttttaaggatga

SEQ ID NO: 18449 - DNA, 23 bp, Artificial Sequence
  Synthetic
ccgttttttttttttacagctag

SEQ ID NO: 18450 - DNA, 23 bp, Artificial Sequence
  Synthetic
ccgttttttttttttcggttatc

SEQ ID NO: 18451 - DNA, 23 bp, Artificial Sequence
  Synthetic
ccgttttttttttttggccggga

SEQ ID NO: 18452 - DNA, 23 bp, Artificial Sequence
  Synthetic
ccgttttttttttttggccggga

SEQ ID NO: 18453 - DNA, 23 bp, Artificial Sequence
  Synthetic
ccgttttttttttttcctgcacg

SEQ ID NO: 18454 - DNA, 23 bp, Artificial Sequence
  Synthetic
ccgttttttttttttcaataaat

SEQ ID NO: 18455 - DNA, 23 bp, Artificial Sequence
  Synthetic
ccgttttttttttttaaaaatgt

SEQ ID NO: 18456 - DNA, 23 bp, Artificial Sequence
  Synthetic
ccgttttttttttttcaatacaa

SEQ ID NO: 18457 - DNA, 23 bp, Artificial Sequence
  Synthetic
ccgttttttttttttcaagatcg

SEQ ID NO: 18458 - DNA, 23 bp, Artificial Sequence
  Synthetic
ccgttttttttttttcaaggtcg

SEQ ID NO: 18459 - DNA, 23 bp, Artificial Sequence
  Synthetic
ccgttttttttttttcacttccc

SEQ ID NO: 18460 - DNA, 23 bp, Artificial Sequence
  Synthetic
ccgttttttttttttacacccag

SEQ ID NO: 18461 - DNA, 23 bp, Artificial Sequence
  Synthetic
ccgttttttttttttcactcggg

SEQ ID NO: 18462 - DNA, 23 bp, Artificial Sequence
  Synthetic
ccgttttttttttttcactcggg

SEQ ID NO: 18463 - DNA, 23 bp, Artificial Sequence
  Synthetic
ccgttttttttttttgacacagg

SEQ ID NO: 18464 - DNA, 23 bp, Artificial Sequence
  Synthetic
ccgttttttttttttgagaggaa

SEQ ID NO: 18465 - DNA, 23 bp, Artificial Sequence
  Synthetic
ccgttttttttttttgatcgacc

SEQ ID NO: 18466 - DNA, 23 bp, Artificial Sequence
  Synthetic
ccgttttttttttttctgccgtc

SEQ ID NO: 18467 - DNA, 23 bp, Artificial Sequence
  Synthetic
ccgttttttttttttacattctg

SEQ ID NO: 18468 - DNA, 23 bp, Artificial Sequence
  Synthetic
ccgttttttttttttgctaggcc

SEQ ID NO: 18469 - DNA, 23 bp, Artificial Sequence
  Synthetic
ccgttttttttttttagagtact

SEQ ID NO: 18470 - DNA, 23 bp, Artificial Sequence
  Synthetic
ccgttttttttttttggcaagtt

SEQ ID NO: 18471 - DNA, 23 bp, Artificial Sequence
  Synthetic
ccgttttttttttttaacagccc

SEQ ID NO: 18472 - DNA, 23 bp, Artificial Sequence
  Synthetic
ccgttttttttttttgatggatt

SEQ ID NO: 18473 - DNA, 23 bp, Artificial Sequence
  Synthetic
ccgttttttttttttcgccagca

SEQ ID NO: 18474 - DNA, 23 bp, Artificial Sequence
  Synthetic
ccgttttttttttttgctctctc

SEQ ID NO: 18475 - DNA, 23 bp, Artificial Sequence
  Synthetic
ccgttttttttttttgcagctgc

SEQ ID NO: 18476 - DNA, 23 bp, Artificial Sequence
  Synthetic
ccgttttttttttttcggggttt

SEQ ID NO: 18477 - DNA, 23 bp, Artificial Sequence
  Synthetic
ccgttttttttttttcaagttag

SEQ ID NO: 18478 - DNA, 23 bp, Artificial Sequence
  Synthetic
ccgttttttttttttcaaaccat

SEQ ID NO: 18479 - DNA, 23 bp, Artificial Sequence
  Synthetic
ccgttttttttttttccaatatt

SEQ ID NO: 18480 - DNA, 23 bp, Artificial Sequence
  Synthetic
ccgttttttttttttaagtgcct

SEQ ID NO: 18481 - DNA, 23 bp, Artificial Sequence
  Synthetic
ccgttttttttttttacctgcac

SEQ ID NO: 18482 - DNA, 23 bp, Artificial Sequence
  Synthetic
ccgttttttttttttgcactaga

SEQ ID NO: 18483 - DNA, 23 bp, Artificial Sequence
  Synthetic
ccgttttttttttttgttttgca

SEQ ID NO: 18484 - DNA, 23 bp, Artificial Sequence
  Synthetic
ccgttttttttttttgttttgca

SEQ ID NO: 18485 - DNA, 23 bp, Artificial Sequence
  Synthetic
ccgttttttttttttctgcacta

SEQ ID NO: 18486 - DNA, 23 bp, Artificial Sequence
  Synthetic
ccgttttttttttttcagttgcc

SEQ ID NO: 18487 - DNA, 23 bp, Artificial Sequence
  Synthetic
ccgttttttttttttatggttag

SEQ ID NO: 18488 - DNA, 23 bp, Artificial Sequence
  Synthetic
ccgttttttttttttagttcttc

SEQ ID NO: 18489 - DNA, 23 bp, Artificial Sequence
  Synthetic
ccgttttttttttttaaatccct

SEQ ID NO: 18490 - DNA, 23 bp, Artificial Sequence
  Synthetic
ccgttttttttttttcggaactt

SEQ ID NO: 18491 - DNA, 23 bp, Artificial Sequence
  Synthetic
ccgttttttttttttaggccggg

SEQ ID NO: 18492 - DNA, 23 bp, Artificial Sequence
  Synthetic
ccgttttttttttttcaagttcg

SEQ ID NO: 18493 - DNA, 23 bp, Artificial Sequence
  Synthetic
ccgttttttttttttagttatca

SEQ ID NO: 18494 - DNA, 23 bp, Artificial Sequence
  Synthetic
ccgttttttttttttagccctgt

SEQ ID NO: 18495 - DNA, 23 bp, Artificial Sequence
  Synthetic
ccgttttttttttttaggagtct

SEQ ID NO: 18496 - DNA, 23 bp, Artificial Sequence
  Synthetic
ccgttttttttttttgcactgtc

SEQ ID NO: 18497 - DNA, 23 bp, Artificial Sequence
  Synthetic
ccgttttttttttttagccctgt

SEQ ID NO: 18498 - DNA, 23 bp, Artificial Sequence
  Synthetic
ccgttttttttttttcattcacc

SEQ ID NO: 18499 - DNA, 23 bp, Artificial Sequence
  Synthetic
ccgttttttttttttcaagttag

SEQ ID NO: 18500 - DNA, 23 bp, Artificial Sequence
  Synthetic
ccgttttttttttttccaagctc

SEQ ID NO: 18501 - DNA, 23 bp, Artificial Sequence
  Synthetic
ccgttttttttttttagctggtt

SEQ ID NO: 18502 - DNA, 23 bp, Artificial Sequence
  Synthetic
ccgttttttttttttcataggaa

SEQ ID NO: 18503 - DNA, 23 bp, Artificial Sequence
  Synthetic
ccgttttttttttttacacgtgc

SEQ ID NO: 18504 - DNA, 23 bp, Artificial Sequence
  Synthetic
ccgttttttttttttgctacagt

SEQ ID NO: 18505 - DNA, 23 bp, Artificial Sequence
  Synthetic
ccgttttttttttttcaaaccat

SEQ ID NO: 18506 - DNA, 23 bp, Artificial Sequence
  Synthetic
ccgttttttttttttaaccatga

SEQ ID NO: 18507 - DNA, 23 bp, Artificial Sequence
  Synthetic
ccgttttttttttttccaatatt

SEQ ID NO: 18508 - DNA, 23 bp, Artificial Sequence
  Synthetic
ccgttttttttttttaagtgcct

SEQ ID NO: 18509 - DNA, 23 bp, Artificial Sequence
  Synthetic
ccgttttttttttttacctgcac

SEQ ID NO: 18510 - DNA, 23 bp, Artificial Sequence
  Synthetic
ccgttttttttttttgcactaga

SEQ ID NO: 18511 - DNA, 23 bp, Artificial Sequence
  Synthetic
ccgttttttttttttcaccgaca

SEQ ID NO: 18512 - DNA, 23 bp, Artificial Sequence
  Synthetic
ccgttttttttttttacaatcaa

SEQ ID NO: 18513 - DNA, 23 bp, Artificial Sequence
  Synthetic
ccgttttttttttttcccaccga

SEQ ID NO: 18514 - DNA, 23 bp, Artificial Sequence
  Synthetic
ccgttttttttttttcaacaaca

SEQ ID NO: 18515 - DNA, 23 bp, Artificial Sequence
  Synthetic
ccgttttttttttttagctccct

SEQ ID NO: 18516 - DNA, 23 bp, Artificial Sequence
  Synthetic
ccgttttttttttttacaggtag

SEQ ID NO: 18517 - DNA, 23 bp, Artificial Sequence
  Synthetic
ccgttttttttttttgttttgca

SEQ ID NO: 18518 - DNA, 23 bp, Artificial Sequence
  Synthetic
ccgttttttttttttgttttgca

SEQ ID NO: 18519 - DNA, 23 bp, Artificial Sequence
  Synthetic
ccgttttttttttttctgcacta

SEQ ID NO: 18520 - DNA, 23 bp, Artificial Sequence
  Synthetic
ccgttttttttttttgactccgg

SEQ ID NO: 18521 - DNA, 23 bp, Artificial Sequence
  Synthetic
ccgttttttttttttatggttag

SEQ ID NO: 18522 - DNA, 23 bp, Artificial Sequence
  Synthetic
ccgttttttttttttagttcttc

SEQ ID NO: 18523 - DNA, 23 bp, Artificial Sequence
  Synthetic
ccgttttttttttttgaccgaga

SEQ ID NO: 18524 - DNA, 23 bp, Artificial Sequence
  Synthetic
ccgttttttttttttcctatcct

SEQ ID NO: 18525 - DNA, 23 bp, Artificial Sequence
  Synthetic
ccgttttttttttttaatagact

SEQ ID NO: 18526 - DNA, 23 bp, Artificial Sequence
  Synthetic
ccgttttttttttttccgatttc

SEQ ID NO: 18527 - DNA, 23 bp, Artificial Sequence
  Synthetic
ccgttttttttttttgatttcaa

SEQ ID NO: 18528 - DNA, 23 bp, Artificial Sequence
  Synthetic
ccgttttttttttttgagtgtag

SEQ ID NO: 18529 - DNA, 23 bp, Artificial Sequence
  Synthetic
ccgttttttttttttgagagtgt

SEQ ID NO: 18530 - DNA, 23 bp, Artificial Sequence
  Synthetic
ccgttttttttttttaaccagct

SEQ ID NO: 18531 - DNA, 23 bp, Artificial Sequence
  Synthetic
ccgttttttttttttcaaaatca

SEQ ID NO: 18532 - DNA, 23 bp, Artificial Sequence
  Synthetic
ccgttttttttttttacagctag

SEQ ID NO: 18533 - DNA, 23 bp, Artificial Sequence
  Synthetic
ccgttttttttttttaggccggg

SEQ ID NO: 18534 - DNA, 23 bp, Artificial Sequence
  Synthetic
ccgttttttttttttcctgcacg

SEQ ID NO: 18535 - DNA, 23 bp, Artificial Sequence
  Synthetic
ccgttttttttttttcaataaat

SEQ ID NO: 18536 - DNA, 23 bp, Artificial Sequence
  Synthetic
ccgttttttttttttcaagatcg

SEQ ID NO: 18537 - DNA, 23 bp, Artificial Sequence
  Synthetic
ccgttttttttttttctatacaa

SEQ ID NO: 18538 - DNA, 23 bp, Artificial Sequence
  Synthetic
ccgttttttttttttccacacaa

SEQ ID NO: 18539 - DNA, 23 bp, Artificial Sequence
  Synthetic
ccgttttttttttttatgcaacc

SEQ ID NO: 18540 - DNA, 23 bp, Artificial Sequence
  Synthetic
ccgttttttttttttctatacaa

SEQ ID NO: 18541 - DNA, 23 bp, Artificial Sequence
  Synthetic
ccgttttttttttttgtacaaac

SEQ ID NO: 18542 - DNA, 23 bp, Artificial Sequence
  Synthetic
ccgttttttttttttagcacaaa

SEQ ID NO: 18543 - DNA, 23 bp, Artificial Sequence
  Synthetic
ccgttttttttttttatacttct

SEQ ID NO: 18544 - DNA, 23 bp, Artificial Sequence
  Synthetic
ccgttttttttttttaagttcgg

SEQ ID NO: 18545 - DNA, 23 bp, Artificial Sequence
  Synthetic
ccgttttttttttttagttatca

SEQ ID NO: 18546 - DNA, 23 bp, Artificial Sequence
  Synthetic
ccgttttttttttttagccctgt

SEQ ID NO: 18547 - DNA, 23 bp, Artificial Sequence
  Synthetic
ccgttttttttttttagccctgt

SEQ ID NO: 18548 - DNA, 23 bp, Artificial Sequence
  Synthetic
ccgttttttttttttcaaattcg

SEQ ID NO: 18549 - DNA, 23 bp, Artificial Sequence
  Synthetic
ccgttttttttttttaaattcgg

SEQ ID NO: 18550 - DNA, 23 bp, Artificial Sequence
  Synthetic
ccgttttttttttttacaaacac

SEQ ID NO: 18551 - DNA, 23 bp, Artificial Sequence
  Synthetic
ccgttttttttttttcattcacc

SEQ ID NO: 18552 - DNA, 23 bp, Artificial Sequence
  Synthetic
ccgttttttttttttcaagttag

SEQ ID NO: 18553 - DNA, 23 bp, Artificial Sequence
  Synthetic
ccgttttttttttttagagaccg

SEQ ID NO: 18554 - DNA, 23 bp, Artificial Sequence
  Synthetic
ccgttttttttttttcaagccca

SEQ ID NO: 18555 - DNA, 23 bp, Artificial Sequence
  Synthetic
ccgttttttttttttcccttttt

SEQ ID NO: 18556 - DNA, 23 bp, Artificial Sequence
  Synthetic
ccgttttttttttttaccatggc

SEQ ID NO: 18557 - DNA, 23 bp, Artificial Sequence
  Synthetic
ccgttttttttttttagctggtt

SEQ ID NO: 18558 - DNA, 23 bp, Artificial Sequence
  Synthetic
ccgttttttttttttcataggaa

SEQ ID NO: 18559 - DNA, 23 bp, Artificial Sequence
  Synthetic
ccgttttttttttttcataggaa

SEQ ID NO: 18560 - DNA, 23 bp, Artificial Sequence
  Synthetic
ccgttttttttttttcgcgtatt

SEQ ID NO: 18561 - DNA, 23 bp, Artificial Sequence
  Synthetic
ccgttttttttttttcacaacac

SEQ ID NO: 18562 - DNA, 23 bp, Artificial Sequence
  Synthetic
ccgttttttttttttatctttac

SEQ ID NO: 18563 - DNA, 23 bp, Artificial Sequence
  Synthetic
ccgttttttttttttataaagta

SEQ ID NO: 18564 - DNA, 23 bp, Artificial Sequence
  Synthetic
ccgttttttttttttagctacag

SEQ ID NO: 18565 - DNA, 23 bp, Artificial Sequence
  Synthetic
ccgttttttttttttagtacatc

SEQ ID NO: 18566 - DNA, 23 bp, Artificial Sequence
  Synthetic
ccgttttttttttttggattcct

SEQ ID NO: 18567 - DNA, 23 bp, Artificial Sequence
  Synthetic
ccgttttttttttttcaagttct

SEQ ID NO: 18568 - DNA, 23 bp, Artificial Sequence
  Synthetic
ccgttttttttttttcaaaccat

SEQ ID NO: 18569 - DNA, 23 bp, Artificial Sequence
  Synthetic
ccgttttttttttttccaatatt

SEQ ID NO: 18570 - DNA, 23 bp, Artificial Sequence
  Synthetic
ccgttttttttttttaagtgcct

SEQ ID NO: 18571 - DNA, 23 bp, Artificial Sequence
  Synthetic
ccgttttttttttttacctgcac

SEQ ID NO: 18572 - DNA, 23 bp, Artificial Sequence
  Synthetic
ccgttttttttttttgcactaga

SEQ ID NO: 18573 - DNA, 23 bp, Artificial Sequence
  Synthetic
ccgttttttttttttcaccgaca

SEQ ID NO: 18574 - DNA, 23 bp, Artificial Sequence
  Synthetic
ccgttttttttttttcaccgaca

SEQ ID NO: 18575 - DNA, 23 bp, Artificial Sequence
  Synthetic
ccgttttttttttttcaccgaca

SEQ ID NO: 18576 - DNA, 23 bp, Artificial Sequence
  Synthetic
ccgttttttttttttagttctac

SEQ ID NO: 18577 - DNA, 23 bp, Artificial Sequence
  Synthetic
ccgttttttttttttgtgaattc

SEQ ID NO: 18578 - DNA, 23 bp, Artificial Sequence
  Synthetic
ccgttttttttttttccttatca

SEQ ID NO: 18579 - DNA, 23 bp, Artificial Sequence
  Synthetic
ccgttttttttttttgcccaaaa

SEQ ID NO: 18580 - DNA, 23 bp, Artificial Sequence
  Synthetic
ccgttttttttttttctgcaaca

SEQ ID NO: 18581 - DNA, 23 bp, Artificial Sequence
  Synthetic
ccgttttttttttttctgctttt

SEQ ID NO: 18582 - DNA, 23 bp, Artificial Sequence
  Synthetic
ccgttttttttttttggactttg

SEQ ID NO: 18583 - DNA, 23 bp, Artificial Sequence
  Synthetic
ccgttttttttttttaacaacag

SEQ ID NO: 18584 - DNA, 23 bp, Artificial Sequence
  Synthetic
ccgttttttttttttacagatag

SEQ ID NO: 18585 - DNA, 23 bp, Artificial Sequence
  Synthetic
ccgttttttttttttgttttgca

SEQ ID NO: 18586 - DNA, 23 bp, Artificial Sequence
  Synthetic
ccgttttttttttttgttttgca

SEQ ID NO: 18587 - DNA, 23 bp, Artificial Sequence
  Synthetic
ccgttttttttttttcctgcact

SEQ ID NO: 18588 - DNA, 23 bp, Artificial Sequence
  Synthetic
ccgttttttttttttatcgttac

SEQ ID NO: 18589 - DNA, 23 bp, Artificial Sequence
  Synthetic
ccgttttttttttttagcactgt

SEQ ID NO: 18590 - DNA, 23 bp, Artificial Sequence
  Synthetic
ccgttttttttttttcattacca

SEQ ID NO: 18591 - DNA, 23 bp, Artificial Sequence
  Synthetic
ccgttttttttttttatcattac

SEQ ID NO: 18592 - DNA, 23 bp, Artificial Sequence
  Synthetic
ccgttttttttttttagtggtcc

SEQ ID NO: 18593 - DNA, 23 bp, Artificial Sequence
  Synthetic
ccgttttttttttttgcatagga

SEQ ID NO: 18594 - DNA, 23 bp, Artificial Sequence
  Synthetic
ccgttttttttttttcacacttc

SEQ ID NO: 18595 - DNA, 23 bp, Artificial Sequence
  Synthetic
ccgttttttttttttgagctttt

SEQ ID NO: 18596 - DNA, 23 bp, Artificial Sequence
  Synthetic
ccgttttttttttttacatcagt

SEQ ID NO: 18597 - DNA, 23 bp, Artificial Sequence
  Synthetic
ccgttttttttttttccgtgact

SEQ ID NO: 18598 - DNA, 23 bp, Artificial Sequence
  Synthetic
ccgttttttttttttcctgtctg

SEQ ID NO: 18599 - DNA, 23 bp, Artificial Sequence
  Synthetic
ccgttttttttttttcagttgcc

SEQ ID NO: 18600 - DNA, 23 bp, Artificial Sequence
  Synthetic
ccgttttttttttttcaatcagt

SEQ ID NO: 18601 - DNA, 23 bp, Artificial Sequence
  Synthetic
ccgttttttttttttatggttag

SEQ ID NO: 18602 - DNA, 23 bp, Artificial Sequence
  Synthetic
ccgttttttttttttaattgcgt

SEQ ID NO: 18603 - DNA, 23 bp, Artificial Sequence
  Synthetic
ccgttttttttttttagttcttc

SEQ ID NO: 18604 - DNA, 23 bp, Artificial Sequence
  Synthetic
ccgttttttttttttaacccagc

SEQ ID NO: 18605 - DNA, 23 bp, Artificial Sequence
  Synthetic
ccgttttttttttttgacccagt

SEQ ID NO: 18606 - DNA, 23 bp, Artificial Sequence
  Synthetic
ccgttttttttttttggtatttg

SEQ ID NO: 18607 - DNA, 23 bp, Artificial Sequence
  Synthetic
ccgttttttttttttaatccctg

SEQ ID NO: 18608 - DNA, 23 bp, Artificial Sequence
  Synthetic
ccgttttttttttttaatccctg

SEQ ID NO: 18609 - DNA, 23 bp, Artificial Sequence
  Synthetic
ccgttttttttttttctgaactg

SEQ ID NO: 18610 - DNA, 23 bp, Artificial Sequence
  Synthetic
ccgttttttttttttgaccgaga

SEQ ID NO: 18611 - DNA, 23 bp, Artificial Sequence
  Synthetic
ccgttttttttttttggaactta

SEQ ID NO: 18612 - DNA, 23 bp, Artificial Sequence
  Synthetic
ccgttttttttttttagaactta

SEQ ID NO: 18613 - DNA, 23 bp, Artificial Sequence
  Synthetic
ccgttttttttttttcgatttca

SEQ ID NO: 18614 - DNA, 23 bp, Artificial Sequence
  Synthetic
ccgttttttttttttgatttcaa

SEQ ID NO: 18615 - DNA, 23 bp, Artificial Sequence
  Synthetic
ccgttttttttttttaaacatgg

SEQ ID NO: 18616 - DNA, 23 bp, Artificial Sequence
  Synthetic
ccgttttttttttttaaaacatg

SEQ ID NO: 18617 - DNA, 23 bp, Artificial Sequence
  Synthetic
ccgttttttttttttgaaacatg

SEQ ID NO: 18618 - DNA, 23 bp, Artificial Sequence
  Synthetic
ccgttttttttttttcaaacatg

SEQ ID NO: 18619 - DNA, 23 bp, Artificial Sequence
  Synthetic
ccgttttttttttttcagtcgag

SEQ ID NO: 18620 - DNA, 23 bp, Artificial Sequence
  Synthetic
ccgttttttttttttgctatgcc

SEQ ID NO: 18621 - DNA, 23 bp, Artificial Sequence
  Synthetic
ccgttttttttttttaacttagt

SEQ ID NO: 18622 - DNA, 23 bp, Artificial Sequence
  Synthetic
ccgttttttttttttacaaaatc

SEQ ID NO: 18623 - DNA, 23 bp, Artificial Sequence
  Synthetic
ccgttttttttttttcaaccagc

SEQ ID NO: 18624 - DNA, 23 bp, Artificial Sequence
  Synthetic
ccgttttttttttttaggatttt

SEQ ID NO: 18625 - DNA, 23 bp, Artificial Sequence
  Synthetic
ccgttttttttttttccattgct

SEQ ID NO: 18626 - DNA, 23 bp, Artificial Sequence
  Synthetic
ccgttttttttttttcgcgagcc

SEQ ID NO: 18627 - DNA, 23 bp, Artificial Sequence
  Synthetic
ccgttttttttttttccacaatc

SEQ ID NO: 18628 - DNA, 23 bp, Artificial Sequence
  Synthetic
ccgttttttttttttacggacac

SEQ ID NO: 18629 - DNA, 23 bp, Artificial Sequence
  Synthetic
ccgttttttttttttcagctaac

SEQ ID NO: 18630 - DNA, 23 bp, Artificial Sequence
  Synthetic
ccgttttttttttttcacagtaa

SEQ ID NO: 18631 - DNA, 23 bp, Artificial Sequence
  Synthetic
ccgttttttttttttacaaaatc

SEQ ID NO: 18632 - DNA, 23 bp, Artificial Sequence
  Synthetic
ccgttttttttttttacagctag

SEQ ID NO: 18633 - DNA, 23 bp, Artificial Sequence
  Synthetic
ccgttttttttttttcggttatc

SEQ ID NO: 18634 - DNA, 23 bp, Artificial Sequence
  Synthetic
ccgttttttttttttggccggga

SEQ ID NO: 18635 - DNA, 23 bp, Artificial Sequence
  Synthetic
ccgttttttttttttcctgcacg

SEQ ID NO: 18636 - DNA, 23 bp, Artificial Sequence
  Synthetic
ccgttttttttttttcaaaaatg

SEQ ID NO: 18637 - DNA, 23 bp, Artificial Sequence
  Synthetic
ccgttttttttttttcgcacagt

SEQ ID NO: 18638 - DNA, 23 bp, Artificial Sequence
  Synthetic
ccgttttttttttttgactaccg

SEQ ID NO: 18639 - DNA, 23 bp, Artificial Sequence
  Synthetic
ccgttttttttttttgctattct

SEQ ID NO: 18640 - DNA, 23 bp, Artificial Sequence
  Synthetic
ccgttttttttttttgggagagg

SEQ ID NO: 18641 - DNA, 23 bp, Artificial Sequence
  Synthetic
ccgttttttttttttagggttcc

SEQ ID NO: 18642 - DNA, 23 bp, Artificial Sequence
  Synthetic
ccgttttttttttttcatgctgt

SEQ ID NO: 18643 - DNA, 23 bp, Artificial Sequence
  Synthetic
ccgttttttttttttagtagacg

SEQ ID NO: 18644 - DNA, 23 bp, Artificial Sequence
  Synthetic
ccgttttttttttttgtcatttc

SEQ ID NO: 18645 - DNA, 23 bp, Artificial Sequence
  Synthetic
ccgttttttttttttaatctcgt

SEQ ID NO: 18646 - DNA, 23 bp, Artificial Sequence
  Synthetic
ccgttttttttttttattgttcc

SEQ ID NO: 18647 - DNA, 23 bp, Artificial Sequence
  Synthetic
ccgttttttttttttaggaagta

SEQ ID NO: 18648 - DNA, 23 bp, Artificial Sequence
  Synthetic
ccgttttttttttttagaggggg

SEQ ID NO: 18649 - DNA, 23 bp, Artificial Sequence
  Synthetic
ccgttttttttttttgcgcaact

SEQ ID NO: 18650 - DNA, 23 bp, Artificial Sequence
  Synthetic
ccgttttttttttttaataacac

SEQ ID NO: 18651 - DNA, 23 bp, Artificial Sequence
  Synthetic
ccgttttttttttttgacgaccc

SEQ ID NO: 18652 - DNA, 23 bp, Artificial Sequence
  Synthetic
ccgttttttttttttaaccacct

SEQ ID NO: 18653 - DNA, 23 bp, Artificial Sequence
  Synthetic
ccgttttttttttttaaaggtgg

SEQ ID NO: 18654 - DNA, 23 bp, Artificial Sequence
  Synthetic
ccgttttttttttttgttaccgc

SEQ ID NO: 18655 - DNA, 23 bp, Artificial Sequence
  Synthetic
ccgttttttttttttccaaaccc

SEQ ID NO: 18656 - DNA, 23 bp, Artificial Sequence
  Synthetic
ccgttttttttttttaaaggtcc

SEQ ID NO: 18657 - DNA, 23 bp, Artificial Sequence
  Synthetic
ccgttttttttttttcaagttcg

SEQ ID NO: 18658 - DNA, 23 bp, Artificial Sequence
  Synthetic
ccgttttttttttttagttatca

SEQ ID NO: 18659 - DNA, 23 bp, Artificial Sequence
  Synthetic
ccgttttttttttttagccctgt

SEQ ID NO: 18660 - DNA, 23 bp, Artificial Sequence
  Synthetic
ccgttttttttttttaggagtct

SEQ ID NO: 18661 - DNA, 23 bp, Artificial Sequence
  Synthetic
ccgttttttttttttacctgcac

SEQ ID NO: 18662 - DNA, 23 bp, Artificial Sequence
  Synthetic
ccgttttttttttttgcactgtc

SEQ ID NO: 18663 - DNA, 23 bp, Artificial Sequence
  Synthetic
ccgttttttttttttagccctgt

SEQ ID NO: 18664 - DNA, 23 bp, Artificial Sequence
  Synthetic
ccgttttttttttttcattcacc

SEQ ID NO: 18665 - DNA, 23 bp, Artificial Sequence
  Synthetic
ccgttttttttttttcaagttag

SEQ ID NO: 18666 - DNA, 23 bp, Artificial Sequence
  Synthetic
ccgttttttttttttccaagctc

SEQ ID NO: 18667 - DNA, 23 bp, Artificial Sequence
  Synthetic
ccgttttttttttttaagagacc

SEQ ID NO: 18668 - DNA, 23 bp, Artificial Sequence
  Synthetic
ccgttttttttttttccttttaa

SEQ ID NO: 18669 - DNA, 23 bp, Artificial Sequence
  Synthetic
ccgttttttttttttagctggtt

SEQ ID NO: 18670 - DNA, 23 bp, Artificial Sequence
  Synthetic
ccgttttttttttttcataggaa

SEQ ID NO: 18671 - DNA, 23 bp, Artificial Sequence
  Synthetic
ccgttttttttttttatctttac

SEQ ID NO: 18672 - DNA, 23 bp, Artificial Sequence
  Synthetic
ccgttttttttttttgggattcc

SEQ ID NO: 18673 - DNA, 23 bp, Artificial Sequence
  Synthetic
ccgttttttttttttcttttgtg

SEQ ID NO: 18674 - DNA, 23 bp, Artificial Sequence
  Synthetic
ccgttttttttttttcaaaccat

SEQ ID NO: 18675 - DNA, 23 bp, Artificial Sequence
  Synthetic
ccgttttttttttttaaccatga

SEQ ID NO: 18676 - DNA, 23 bp, Artificial Sequence
  Synthetic
ccgttttttttttttccaatatt

SEQ ID NO: 18677 - DNA, 23 bp, Artificial Sequence
  Synthetic
ccgttttttttttttaagtgcct

SEQ ID NO: 18678 - DNA, 23 bp, Artificial Sequence
  Synthetic
ccgttttttttttttacctgcac

SEQ ID NO: 18679 - DNA, 23 bp, Artificial Sequence
  Synthetic
ccgttttttttttttgcactaga

SEQ ID NO: 18680 - DNA, 23 bp, Artificial Sequence
  Synthetic
ccgttttttttttttcaccgaca

SEQ ID NO: 18681 - DNA, 23 bp, Artificial Sequence
  Synthetic
ccgttttttttttttacaatcaa

SEQ ID NO: 18682 - DNA, 23 bp, Artificial Sequence
  Synthetic
ccgttttttttttttcccaccga

SEQ ID NO: 18683 - DNA, 23 bp, Artificial Sequence
  Synthetic
ccgttttttttttttcaccgaca

SEQ ID NO: 18684 - DNA, 23 bp, Artificial Sequence
  Synthetic
ccgttttttttttttagttctac

SEQ ID NO: 18685 - DNA, 23 bp, Artificial Sequence
  Synthetic
ccgttttttttttttgtgaattc

SEQ ID NO: 18686 - DNA, 23 bp, Artificial Sequence
  Synthetic
ccgttttttttttttcctccacc

SEQ ID NO: 18687 - DNA, 23 bp, Artificial Sequence
  Synthetic
ccgttttttttttttgatatcag

SEQ ID NO: 18688 - DNA, 23 bp, Artificial Sequence
  Synthetic
ccgttttttttttttctaatata

SEQ ID NO: 18689 - DNA, 23 bp, Artificial Sequence
  Synthetic
ccgttttttttttttacatggag

SEQ ID NO: 18690 - DNA, 23 bp, Artificial Sequence
  Synthetic
ccgttttttttttttaacaacat

SEQ ID NO: 18691 - DNA, 23 bp, Artificial Sequence
  Synthetic
ccgttttttttttttatttcccc

SEQ ID NO: 18692 - DNA, 23 bp, Artificial Sequence
  Synthetic
ccgttttttttttttacaggtag

SEQ ID NO: 18693 - DNA, 23 bp, Artificial Sequence
  Synthetic
ccgttttttttttttgttttgca

SEQ ID NO: 18694 - DNA, 23 bp, Artificial Sequence
  Synthetic
ccgttttttttttttgttttgca

SEQ ID NO: 18695 - DNA, 23 bp, Artificial Sequence
  Synthetic
ccgttttttttttttctgcacta

SEQ ID NO: 18696 - DNA, 23 bp, Artificial Sequence
  Synthetic
ccgttttttttttttatcattac

SEQ ID NO: 18697 - DNA, 23 bp, Artificial Sequence
  Synthetic
ccgttttttttttttacatcagt

SEQ ID NO: 18698 - DNA, 23 bp, Artificial Sequence
  Synthetic
ccgttttttttttttgcaaagga

SEQ ID NO: 18699 - DNA, 23 bp, Artificial Sequence
  Synthetic
ccgttttttttttttcctgtctg

SEQ ID NO: 18700 - DNA, 23 bp, Artificial Sequence
  Synthetic
ccgttttttttttttgtcaattc

SEQ ID NO: 18701 - DNA, 23 bp, Artificial Sequence
  Synthetic
ccgttttttttttttatggttag

SEQ ID NO: 18702 - DNA, 23 bp, Artificial Sequence
  Synthetic
ccgttttttttttttaattgcgt

SEQ ID NO: 18703 - DNA, 23 bp, Artificial Sequence
  Synthetic
ccgttttttttttttagttcttc

SEQ ID NO: 18704 - DNA, 23 bp, Artificial Sequence
  Synthetic
ccgttttttttttttagtgtcag

SEQ ID NO: 18705 - DNA, 23 bp, Artificial Sequence
  Synthetic
ccgttttttttttttaacccagc

SEQ ID NO: 18706 - DNA, 23 bp, Artificial Sequence
  Synthetic
ccgttttttttttttggtatttg

SEQ ID NO: 18707 - DNA, 23 bp, Artificial Sequence
  Synthetic
ccgttttttttttttacggaacc

SEQ ID NO: 18708 - DNA, 23 bp, Artificial Sequence
  Synthetic
ccgttttttttttttaaatccct

SEQ ID NO: 18709 - DNA, 23 bp, Artificial Sequence
  Synthetic
ccgttttttttttttcctgctga

SEQ ID NO: 18710 - DNA, 23 bp, Artificial Sequence
  Synthetic
ccgttttttttttttgaccgaga

SEQ ID NO: 18711 - DNA, 23 bp, Artificial Sequence
  Synthetic
ccgttttttttttttcctatcct

SEQ ID NO: 18712 - DNA, 23 bp, Artificial Sequence
  Synthetic
ccgttttttttttttcggaactt

SEQ ID NO: 18713 - DNA, 23 bp, Artificial Sequence
  Synthetic
ccgttttttttttttaatagact

SEQ ID NO: 18714 - DNA, 23 bp, Artificial Sequence
  Synthetic
ccgttttttttttttccgatttc

SEQ ID NO: 18715 - DNA, 23 bp, Artificial Sequence
  Synthetic
ccgttttttttttttgcaaacat

SEQ ID NO: 18716 - DNA, 23 bp, Artificial Sequence
  Synthetic
ccgttttttttttttcagtcgag

SEQ ID NO: 18717 - DNA, 23 bp, Artificial Sequence
  Synthetic
ccgttttttttttttgagtgtag

SEQ ID NO: 18718 - DNA, 23 bp, Artificial Sequence
  Synthetic
ccgttttttttttttgctatgcc

SEQ ID NO: 18719 - DNA, 23 bp, Artificial Sequence
  Synthetic
ccgttttttttttttaacttagt

SEQ ID NO: 18720 - DNA, 23 bp, Artificial Sequence
  Synthetic
ccgttttttttttttatgcaact

SEQ ID NO: 18721 - DNA, 23 bp, Artificial Sequence
  Synthetic
ccgttttttttttttaaccagct

SEQ ID NO: 18722 - DNA, 23 bp, Artificial Sequence
  Synthetic
ccgttttttttttttaggccggg

SEQ ID NO: 18723 - DNA, 23 bp, Artificial Sequence
  Synthetic
ccgttttttttttttcctgcacg

SEQ ID NO: 18724 - DNA, 23 bp, Artificial Sequence
  Synthetic
ccgttttttttttttaaaaatgt

SEQ ID NO: 18725 - DNA, 23 bp, Artificial Sequence
  Synthetic
ccgttttttttttttcaatacaa

SEQ ID NO: 18726 - DNA, 23 bp, Artificial Sequence
  Synthetic
ccgttttttttttttcaagatcg

SEQ ID NO: 18727 - DNA, 23 bp, Artificial Sequence
  Synthetic
ccgttttttttttttatacaacc

SEQ ID NO: 18728 - DNA, 23 bp, Artificial Sequence
  Synthetic
ccgttttttttttttccacacaa

SEQ ID NO: 18729 - DNA, 23 bp, Artificial Sequence
  Synthetic
ccgttttttttttttccatacaa

SEQ ID NO: 18730 - DNA, 23 bp, Artificial Sequence
  Synthetic
ccgttttttttttttatgcaacc

SEQ ID NO: 18731 - DNA, 23 bp, Artificial Sequence
  Synthetic
ccgttttttttttttaaaggcag

SEQ ID NO: 18732 - DNA, 23 bp, Artificial Sequence
  Synthetic
ccgttttttttttttatacaacc

SEQ ID NO: 18733 - DNA, 23 bp, Artificial Sequence
  Synthetic
ccgttttttttttttatacaatc

SEQ ID NO: 18734 - DNA, 23 bp, Artificial Sequence
  Synthetic
ccgttttttttttttgtacaaac

SEQ ID NO: 18735 - DNA, 23 bp, Artificial Sequence
  Synthetic
ccgttttttttttttagcacaaa

SEQ ID NO: 18736 - DNA, 23 bp, Artificial Sequence
  Synthetic
ccgttttttttttttatacttct

SEQ ID NO: 18737 - DNA, 23 bp, Artificial Sequence
  Synthetic
ccgttttttttttttcaagttcg

SEQ ID NO: 18738 - DNA, 23 bp, Artificial Sequence
  Synthetic
ccgttttttttttttagttatca

SEQ ID NO: 18739 - DNA, 23 bp, Artificial Sequence
  Synthetic
ccgttttttttttttagctatca

SEQ ID NO: 18740 - DNA, 23 bp, Artificial Sequence
  Synthetic
ccgttttttttttttagccctgt

SEQ ID NO: 18741 - DNA, 23 bp, Artificial Sequence
  Synthetic
ccgttttttttttttctgcactg

SEQ ID NO: 18742 - DNA, 23 bp, Artificial Sequence
  Synthetic
ccgttttttttttttgcactgtc

SEQ ID NO: 18743 - DNA, 23 bp, Artificial Sequence
  Synthetic
ccgttttttttttttagccctgt

SEQ ID NO: 18744 - DNA, 23 bp, Artificial Sequence
  Synthetic
ccgttttttttttttcaaattcg

SEQ ID NO: 18745 - DNA, 23 bp, Artificial Sequence
  Synthetic
ccgttttttttttttacaaattc

SEQ ID NO: 18746 - DNA, 23 bp, Artificial Sequence
  Synthetic
ccgttttttttttttaaacacca

SEQ ID NO: 18747 - DNA, 23 bp, Artificial Sequence
  Synthetic
ccgttttttttttttcattcacc

SEQ ID NO: 18748 - DNA, 23 bp, Artificial Sequence
  Synthetic
ccgttttttttttttcaggttaa

SEQ ID NO: 18749 - DNA, 23 bp, Artificial Sequence
  Synthetic
ccgttttttttttttcaagttag

SEQ ID NO: 18750 - DNA, 23 bp, Artificial Sequence
  Synthetic
ccgttttttttttttattattac

SEQ ID NO: 18751 - DNA, 23 bp, Artificial Sequence
  Synthetic
ccgttttttttttttcgtaccaa

SEQ ID NO: 18752 - DNA, 23 bp, Artificial Sequence
  Synthetic
ccgttttttttttttcaagctca

SEQ ID NO: 18753 - DNA, 23 bp, Artificial Sequence
  Synthetic
ccgttttttttttttaagagacc

SEQ ID NO: 18754 - DNA, 23 bp, Artificial Sequence
  Synthetic
ccgttttttttttttaagagacc

SEQ ID NO: 18755 - DNA, 23 bp, Artificial Sequence
  Synthetic
ccgttttttttttttctttttgg

SEQ ID NO: 18756 - DNA, 23 bp, Artificial Sequence
  Synthetic
ccgttttttttttttcaagccca

SEQ ID NO: 18757 - DNA, 23 bp, Artificial Sequence
  Synthetic
ccgttttttttttttccctttta

SEQ ID NO: 18758 - DNA, 23 bp, Artificial Sequence
  Synthetic
ccgttttttttttttccctttca

SEQ ID NO: 18759 - DNA, 23 bp, Artificial Sequence
  Synthetic
ccgttttttttttttaccatggc

SEQ ID NO: 18760 - DNA, 23 bp, Artificial Sequence
  Synthetic
ccgttttttttttttagctggtt

SEQ ID NO: 18761 - DNA, 23 bp, Artificial Sequence
  Synthetic
ccgttttttttttttgttccatt

SEQ ID NO: 18762 - DNA, 23 bp, Artificial Sequence
  Synthetic
ccgttttttttttttctggttga

SEQ ID NO: 18763 - DNA, 23 bp, Artificial Sequence
  Synthetic
ccgttttttttttttcctctggt

SEQ ID NO: 18764 - DNA, 23 bp, Artificial Sequence
  Synthetic
ccgttttttttttttcataggaa

SEQ ID NO: 18765 - DNA, 23 bp, Artificial Sequence
  Synthetic
ccgttttttttttttcataggaa

SEQ ID NO: 18766 - DNA, 23 bp, Artificial Sequence
  Synthetic
ccgttttttttttttatcatcaa

SEQ ID NO: 18767 - DNA, 23 bp, Artificial Sequence
  Synthetic
ccgttttttttttttcgcgtatt

SEQ ID NO: 18768 - DNA, 23 bp, Artificial Sequence
  Synthetic
ccgttttttttttttcacaacac

SEQ ID NO: 18769 - DNA, 23 bp, Artificial Sequence
  Synthetic
ccgttttttttttttacacgtgc

SEQ ID NO: 18770 - DNA, 23 bp, Artificial Sequence
  Synthetic
ccgttttttttttttccataggg

SEQ ID NO: 18771 - DNA, 23 bp, Artificial Sequence
  Synthetic
ccgttttttttttttgtggttct

SEQ ID NO: 18772 - DNA, 23 bp, Artificial Sequence
  Synthetic
ccgttttttttttttatctttac

SEQ ID NO: 18773 - DNA, 23 bp, Artificial Sequence
  Synthetic
ccgttttttttttttataaagta

SEQ ID NO: 18774 - DNA, 23 bp, Artificial Sequence
  Synthetic
ccgttttttttttttgtgctttc

SEQ ID NO: 18775 - DNA, 23 bp, Artificial Sequence
  Synthetic
ccgttttttttttttgctacagt

SEQ ID NO: 18776 - DNA, 23 bp, Artificial Sequence
  Synthetic
ccgttttttttttttgtacatca

SEQ ID NO: 18777 - DNA, 23 bp, Artificial Sequence
  Synthetic
ccgttttttttttttgggattcc

SEQ ID NO: 18778 - DNA, 23 bp, Artificial Sequence
  Synthetic
ccgttttttttttttcccatgga

SEQ ID NO: 18779 - DNA, 23 bp, Artificial Sequence
  Synthetic
ccgttttttttttttcctatgga

SEQ ID NO: 18780 - DNA, 23 bp, Artificial Sequence
  Synthetic
ccgttttttttttttaaagttct

SEQ ID NO: 18781 - DNA, 23 bp, Artificial Sequence
  Synthetic
ccgttttttttttttaaagttct

SEQ ID NO: 18782 - DNA, 23 bp, Artificial Sequence
  Synthetic
ccgttttttttttttagtgaaga

SEQ ID NO: 18783 - DNA, 23 bp, Artificial Sequence
  Synthetic
ccgttttttttttttctggtaca

SEQ ID NO: 18784 - DNA, 23 bp, Artificial Sequence
  Synthetic
ccgttttttttttttcaaggagc

SEQ ID NO: 18785 - DNA, 23 bp, Artificial Sequence
  Synthetic
ccgttttttttttttcaagttct

SEQ ID NO: 18786 - DNA, 23 bp, Artificial Sequence
  Synthetic
ccgttttttttttttcacttttg

SEQ ID NO: 18787 - DNA, 23 bp, Artificial Sequence
  Synthetic
ccgttttttttttttaaggcaac

SEQ ID NO: 18788 - DNA, 23 bp, Artificial Sequence
  Synthetic
ccgttttttttttttcctatcac

SEQ ID NO: 18789 - DNA, 23 bp, Artificial Sequence
  Synthetic
ccgttttttttttttcaaaccat

SEQ ID NO: 18790 - DNA, 23 bp, Artificial Sequence
  Synthetic
ccgttttttttttttaaccatga

SEQ ID NO: 18791 - DNA, 23 bp, Artificial Sequence
  Synthetic
ccgttttttttttttccaatatt

SEQ ID NO: 18792 - DNA, 23 bp, Artificial Sequence
  Synthetic
ccgttttttttttttaagtgccc

SEQ ID NO: 18793 - DNA, 23 bp, Artificial Sequence
  Synthetic
ccgttttttttttttacctgcac

SEQ ID NO: 18794 - DNA, 23 bp, Artificial Sequence
  Synthetic
ccgttttttttttttgcactaga

SEQ ID NO: 18795 - DNA, 23 bp, Artificial Sequence
  Synthetic
ccgttttttttttttcaccgaca

SEQ ID NO: 18796 - DNA, 23 bp, Artificial Sequence
  Synthetic
ccgttttttttttttacaatcaa

SEQ ID NO: 18797 - DNA, 23 bp, Artificial Sequence
  Synthetic
ccgttttttttttttcaccgaca

SEQ ID NO: 18798 - DNA, 23 bp, Artificial Sequence
  Synthetic
ccgttttttttttttcaccgaca

SEQ ID NO: 18799 - DNA, 23 bp, Artificial Sequence
  Synthetic
ccgttttttttttttagttctac

SEQ ID NO: 18800 - DNA, 23 bp, Artificial Sequence
  Synthetic
ccgttttttttttttgtgaattc

SEQ ID NO: 18801 - DNA, 23 bp, Artificial Sequence
  Synthetic
ccgttttttttttttccttatca

SEQ ID NO: 18802 - DNA, 23 bp, Artificial Sequence
  Synthetic
ccgttttttttttttactgcctt

SEQ ID NO: 18803 - DNA, 23 bp, Artificial Sequence
  Synthetic
ccgttttttttttttgcccaaaa

SEQ ID NO: 18804 - DNA, 23 bp, Artificial Sequence
  Synthetic
ccgttttttttttttggctgcaa

SEQ ID NO: 18805 - DNA, 23 bp, Artificial Sequence
  Synthetic
ccgttttttttttttcctccacc

SEQ ID NO: 18806 - DNA, 23 bp, Artificial Sequence
  Synthetic
ccgttttttttttttgatatcag

SEQ ID NO: 18807 - DNA, 23 bp, Artificial Sequence
  Synthetic
ccgttttttttttttctaatata

SEQ ID NO: 18808 - DNA, 23 bp, Artificial Sequence
  Synthetic
ccgttttttttttttctgctttt

SEQ ID NO: 18809 - DNA, 23 bp, Artificial Sequence
  Synthetic
ccgttttttttttttaattcata

SEQ ID NO: 18810 - DNA, 23 bp, Artificial Sequence
  Synthetic
ccgttttttttttttggactttg

SEQ ID NO: 18811 - DNA, 23 bp, Artificial Sequence
  Synthetic
ccgttttttttttttacatggag

SEQ ID NO: 18812 - DNA, 23 bp, Artificial Sequence
  Synthetic
ccgttttttttttttcaatattt

SEQ ID NO: 18813 - DNA, 23 bp, Artificial Sequence
  Synthetic
ccgttttttttttttaacaacat

SEQ ID NO: 18814 - DNA, 23 bp, Artificial Sequence
  Synthetic
ccgttttttttttttaacaacag

SEQ ID NO: 18815 - DNA, 23 bp, Artificial Sequence
  Synthetic
ccgttttttttttttacaggtag

SEQ ID NO: 18816 - DNA, 23 bp, Artificial Sequence
  Synthetic
ccgttttttttttttccaatgtg

SEQ ID NO: 18817 - DNA, 23 bp, Artificial Sequence
  Synthetic
ccgttttttttttttacaggtag

SEQ ID NO: 18818 - DNA, 23 bp, Artificial Sequence
  Synthetic
ccgttttttttttttgttttgca

SEQ ID NO: 18819 - DNA, 23 bp, Artificial Sequence
  Synthetic
ccgttttttttttttgttttgca

SEQ ID NO: 18820 - DNA, 23 bp, Artificial Sequence
  Synthetic
ccgttttttttttttatcgttac

SEQ ID NO: 18821 - DNA, 23 bp, Artificial Sequence
  Synthetic
ccgttttttttttttatcattac

SEQ ID NO: 18822 - DNA, 23 bp, Artificial Sequence
  Synthetic
ccgttttttttttttatcattac

SEQ ID NO: 18823 - DNA, 23 bp, Artificial Sequence
  Synthetic
ccgttttttttttttaacaatgc

SEQ ID NO: 18824 - DNA, 23 bp, Artificial Sequence
  Synthetic
ccgttttttttttttccatgcgc

SEQ ID NO: 18825 - DNA, 23 bp, Artificial Sequence
  Synthetic
ccgttttttttttttgtggtcct

SEQ ID NO: 18826 - DNA, 23 bp, Artificial Sequence
  Synthetic
ccgttttttttttttggcatagg

SEQ ID NO: 18827 - DNA, 23 bp, Artificial Sequence
  Synthetic
ccgttttttttttttgactccgg

SEQ ID NO: 18828 - DNA, 23 bp, Artificial Sequence
  Synthetic
ccgttttttttttttacacactt

SEQ ID NO: 18829 - DNA, 23 bp, Artificial Sequence
  Synthetic
ccgttttttttttttgggaggag

SEQ ID NO: 18830 - DNA, 23 bp, Artificial Sequence
  Synthetic
ccgttttttttttttaagctttt

SEQ ID NO: 18831 - DNA, 23 bp, Artificial Sequence
  Synthetic
ccgttttttttttttcctgcact

SEQ ID NO: 18832 - DNA, 23 bp, Artificial Sequence
  Synthetic
ccgttttttttttttctgcacta

SEQ ID NO: 18833 - DNA, 23 bp, Artificial Sequence
  Synthetic
ccgttttttttttttacatcagt

SEQ ID NO: 18834 - DNA, 23 bp, Artificial Sequence
  Synthetic
ccgttttttttttttgccgctgt

SEQ ID NO: 18835 - DNA, 23 bp, Artificial Sequence
  Synthetic
ccgttttttttttttgcaaagga

SEQ ID NO: 18836 - DNA, 23 bp, Artificial Sequence
  Synthetic
ccgttttttttttttccgtgact

SEQ ID NO: 18837 - DNA, 23 bp, Artificial Sequence
  Synthetic
ccgttttttttttttcctgtctg

SEQ ID NO: 18838 - DNA, 23 bp, Artificial Sequence
  Synthetic
ccgttttttttttttgtcaaatc

SEQ ID NO: 18839 - DNA, 23 bp, Artificial Sequence
  Synthetic
ccgttttttttttttcagttgcc

SEQ ID NO: 18840 - DNA, 23 bp, Artificial Sequence
  Synthetic
ccgttttttttttttcatttgcc

SEQ ID NO: 18841 - DNA, 23 bp, Artificial Sequence
  Synthetic
ccgttttttttttttcagtcagt

SEQ ID NO: 18842 - DNA, 23 bp, Artificial Sequence
  Synthetic
ccgttttttttttttatggttag

SEQ ID NO: 18843 - DNA, 23 bp, Artificial Sequence
  Synthetic
ccgttttttttttttaattgcgt

SEQ ID NO: 18844 - DNA, 23 bp, Artificial Sequence
  Synthetic
ccgttttttttttttagttcttc

SEQ ID NO: 18845 - DNA, 23 bp, Artificial Sequence
  Synthetic
ccgttttttttttttacccagca

SEQ ID NO: 18846 - DNA, 23 bp, Artificial Sequence
  Synthetic
ccgttttttttttttgacccagt

SEQ ID NO: 18847 - DNA, 23 bp, Artificial Sequence
  Synthetic
ccgttttttttttttggtatttg

SEQ ID NO: 18848 - DNA, 23 bp, Artificial Sequence
  Synthetic
ccgttttttttttttacggaacc

SEQ ID NO: 18849 - DNA, 23 bp, Artificial Sequence
  Synthetic
ccgttttttttttttaaatccct

SEQ ID NO: 18850 - DNA, 23 bp, Artificial Sequence
  Synthetic
ccgttttttttttttaatccctg

SEQ ID NO: 18851 - DNA, 23 bp, Artificial Sequence
  Synthetic
ccgttttttttttttcctgctga

SEQ ID NO: 18852 - DNA, 23 bp, Artificial Sequence
  Synthetic
ccgttttttttttttgaccgaga

SEQ ID NO: 18853 - DNA, 23 bp, Artificial Sequence
  Synthetic
ccgttttttttttttctatcctg

SEQ ID NO: 18854 - DNA, 23 bp, Artificial Sequence
  Synthetic
ccgttttttttttttcctatcct

SEQ ID NO: 18855 - DNA, 23 bp, Artificial Sequence
  Synthetic
ccgttttttttttttggaactta

SEQ ID NO: 18856 - DNA, 23 bp, Artificial Sequence
  Synthetic
ccgttttttttttttagaactta

SEQ ID NO: 18857 - DNA, 23 bp, Artificial Sequence
  Synthetic
ccgttttttttttttaatagact

SEQ ID NO: 18858 - DNA, 23 bp, Artificial Sequence
  Synthetic
ccgttttttttttttaaagtgcc

SEQ ID NO: 18859 - DNA, 23 bp, Artificial Sequence
  Synthetic
ccgttttttttttttcacacaaa

SEQ ID NO: 18860 - DNA, 23 bp, Artificial Sequence
  Synthetic
ccgttttttttttttagagggcc

SEQ ID NO: 18861 - DNA, 23 bp, Artificial Sequence
  Synthetic
ccgttttttttttttcaaacaaa

SEQ ID NO: 18862 - DNA, 23 bp, Artificial Sequence
  Synthetic
ccgttttttttttttgagggcct

SEQ ID NO: 18863 - DNA, 23 bp, Artificial Sequence
  Synthetic
ccgttttttttttttactcaaaa

SEQ ID NO: 18864 - DNA, 23 bp, Artificial Sequence
  Synthetic
ccgttttttttttttaaagagcc

SEQ ID NO: 18865 - DNA, 23 bp, Artificial Sequence
  Synthetic
ccgttttttttttttactacaaa

SEQ ID NO: 18866 - DNA, 23 bp, Artificial Sequence
  Synthetic
ccgttttttttttttacacaaaa

SEQ ID NO: 18867 - DNA, 23 bp, Artificial Sequence
  Synthetic
ccgttttttttttttactcaaaa

SEQ ID NO: 18868 - DNA, 23 bp, Artificial Sequence
  Synthetic
ccgttttttttttttaggattga

SEQ ID NO: 18869 - DNA, 23 bp, Artificial Sequence
  Synthetic
ccgttttttttttttgcacatgc

SEQ ID NO: 18870 - DNA, 23 bp, Artificial Sequence
  Synthetic
ccgttttttttttttatgttcat

SEQ ID NO: 18871 - DNA, 23 bp, Artificial Sequence
  Synthetic
ccgttttttttttttaagaacag

SEQ ID NO: 18872 - DNA, 23 bp, Artificial Sequence
  Synthetic
ccgttttttttttttatgtggga

SEQ ID NO: 18873 - DNA, 23 bp, Artificial Sequence
  Synthetic
ccgttttttttttttccgatttc

SEQ ID NO: 18874 - DNA, 23 bp, Artificial Sequence
  Synthetic
ccgttttttttttttcactgatt

SEQ ID NO: 18875 - DNA, 23 bp, Artificial Sequence
  Synthetic
ccgttttttttttttcgatttca

SEQ ID NO: 18876 - DNA, 23 bp, Artificial Sequence
  Synthetic
ccgttttttttttttagagagct

SEQ ID NO: 18877 - DNA, 23 bp, Artificial Sequence
  Synthetic
ccgttttttttttttgacaatac

SEQ ID NO: 18878 - DNA, 23 bp, Artificial Sequence
  Synthetic
ccgttttttttttttgacaatac

SEQ ID NO: 18879 - DNA, 23 bp, Artificial Sequence
  Synthetic
ccgttttttttttttccaaaaca

SEQ ID NO: 18880 - DNA, 23 bp, Artificial Sequence
  Synthetic
ccgttttttttttttctaaaaca

SEQ ID NO: 18881 - DNA, 23 bp, Artificial Sequence
  Synthetic
ccgttttttttttttaaagcatt

SEQ ID NO: 18882 - DNA, 23 bp, Artificial Sequence
  Synthetic
ccgttttttttttttactgaaac

SEQ ID NO: 18883 - DNA, 23 bp, Artificial Sequence
  Synthetic
ccgttttttttttttgcaggtaa

SEQ ID NO: 18884 - DNA, 23 bp, Artificial Sequence
  Synthetic
ccgttttttttttttactcaaac

SEQ ID NO: 18885 - DNA, 23 bp, Artificial Sequence
  Synthetic
ccgttttttttttttgcaaacat

SEQ ID NO: 18886 - DNA, 23 bp, Artificial Sequence
  Synthetic
ccgttttttttttttcagtcgag

SEQ ID NO: 18887 - DNA, 23 bp, Artificial Sequence
  Synthetic
ccgttttttttttttctgagtgt

SEQ ID NO: 18888 - DNA, 23 bp, Artificial Sequence
  Synthetic
ccgttttttttttttgagagtgt

SEQ ID NO: 18889 - DNA, 23 bp, Artificial Sequence
  Synthetic
ccgttttttttttttcagtcggg

SEQ ID NO: 18890 - DNA, 23 bp, Artificial Sequence
  Synthetic
ccgttttttttttttagtcaagg

SEQ ID NO: 18891 - DNA, 23 bp, Artificial Sequence
  Synthetic
ccgttttttttttttaaacatcc

SEQ ID NO: 18892 - DNA, 23 bp, Artificial Sequence
  Synthetic
ccgttttttttttttgctatgcc

SEQ ID NO: 18893 - DNA, 23 bp, Artificial Sequence
  Synthetic
ccgttttttttttttaacttagt

SEQ ID NO: 18894 - DNA, 23 bp, Artificial Sequence
  Synthetic
ccgttttttttttttccctctca

SEQ ID NO: 18895 - DNA, 23 bp, Artificial Sequence
  Synthetic
ccgttttttttttttcagcgctt

SEQ ID NO: 18896 - DNA, 23 bp, Artificial Sequence
  Synthetic
ccgttttttttttttaggtcgac

SEQ ID NO: 18897 - DNA, 23 bp, Artificial Sequence
  Synthetic
ccgttttttttttttagcagcac

SEQ ID NO: 18898 - DNA, 23 bp, Artificial Sequence
  Synthetic
ccgttttttttttttccaatgcc

SEQ ID NO: 18899 - DNA, 23 bp, Artificial Sequence
  Synthetic
ccgttttttttttttacttactg

SEQ ID NO: 18900 - DNA, 23 bp, Artificial Sequence
  Synthetic
ccgttttttttttttggaggaag

SEQ ID NO: 18901 - DNA, 23 bp, Artificial Sequence
  Synthetic
ccgttttttttttttggaagggc

SEQ ID NO: 18902 - DNA, 23 bp, Artificial Sequence
  Synthetic
ccgttttttttttttaaaggtta

SEQ ID NO: 18903 - DNA, 23 bp, Artificial Sequence
  Synthetic
ccgttttttttttttatgcaact

SEQ ID NO: 18904 - DNA, 23 bp, Artificial Sequence
  Synthetic
ccgttttttttttttgcaggccc

SEQ ID NO: 18905 - DNA, 23 bp, Artificial Sequence
  Synthetic
ccgttttttttttttggataggc

SEQ ID NO: 18906 - DNA, 23 bp, Artificial Sequence
  Synthetic
ccgttttttttttttatttttcg

SEQ ID NO: 18907 - DNA, 23 bp, Artificial Sequence
  Synthetic
ccgttttttttttttaggcatca

SEQ ID NO: 18908 - DNA, 23 bp, Artificial Sequence
  Synthetic
ccgttttttttttttacaaaatc

SEQ ID NO: 18909 - DNA, 23 bp, Artificial Sequence
  Synthetic
ccgttttttttttttgctcctgg

SEQ ID NO: 18910 - DNA, 23 bp, Artificial Sequence
  Synthetic
ccgttttttttttttctataaag

SEQ ID NO: 18911 - DNA, 23 bp, Artificial Sequence
  Synthetic
ccgttttttttttttgaccgacc

SEQ ID NO: 18912 - DNA, 23 bp, Artificial Sequence
  Synthetic
ccgttttttttttttcgggtgcg

SEQ ID NO: 18913 - DNA, 23 bp, Artificial Sequence
  Synthetic
ccgttttttttttttagtcaggc

SEQ ID NO: 18914 - DNA, 23 bp, Artificial Sequence
  Synthetic
ccgttttttttttttactggact

SEQ ID NO: 18915 - DNA, 23 bp, Artificial Sequence
  Synthetic
ccgttttttttttttaggcaggc

SEQ ID NO: 18916 - DNA, 23 bp, Artificial Sequence
  Synthetic
ccgttttttttttttcaaccagc

SEQ ID NO: 18917 - DNA, 23 bp, Artificial Sequence
  Synthetic
ccgttttttttttttatcagcta

SEQ ID NO: 18918 - DNA, 23 bp, Artificial Sequence
  Synthetic
ccgttttttttttttaatcagct

SEQ ID NO: 18919 - DNA, 23 bp, Artificial Sequence
  Synthetic
ccgttttttttttttaagtgtat

SEQ ID NO: 18920 - DNA, 23 bp, Artificial Sequence
  Synthetic
ccgttttttttttttggctcaaa

SEQ ID NO: 18921 - DNA, 23 bp, Artificial Sequence
  Synthetic
ccgttttttttttttcccctgga

SEQ ID NO: 18922 - DNA, 23 bp, Artificial Sequence
  Synthetic
ccgttttttttttttcacctagg

SEQ ID NO: 18923 - DNA, 23 bp, Artificial Sequence
  Synthetic
ccgttttttttttttagatggat

SEQ ID NO: 18924 - DNA, 23 bp, Artificial Sequence
  Synthetic
ccgttttttttttttaggatttt

SEQ ID NO: 18925 - DNA, 23 bp, Artificial Sequence
  Synthetic
ccgttttttttttttccattgct

SEQ ID NO: 18926 - DNA, 23 bp, Artificial Sequence
  Synthetic
ccgttttttttttttgatcaacc

SEQ ID NO: 18927 - DNA, 23 bp, Artificial Sequence
  Synthetic
ccgttttttttttttaatataac

SEQ ID NO: 18928 - DNA, 23 bp, Artificial Sequence
  Synthetic
ccgttttttttttttccaggttc

SEQ ID NO: 18929 - DNA, 23 bp, Artificial Sequence
  Synthetic
ccgttttttttttttggacaatg

SEQ ID NO: 18930 - DNA, 23 bp, Artificial Sequence
  Synthetic
ccgttttttttttttcttagcag

SEQ ID NO: 18931 - DNA, 23 bp, Artificial Sequence
  Synthetic
ccgttttttttttttcgcgagcc

SEQ ID NO: 18932 - DNA, 23 bp, Artificial Sequence
  Synthetic
ccgttttttttttttgtggattt

SEQ ID NO: 18933 - DNA, 23 bp, Artificial Sequence
  Synthetic
ccgttttttttttttatagaagg

SEQ ID NO: 18934 - DNA, 23 bp, Artificial Sequence
  Synthetic
ccgttttttttttttagtggatg

SEQ ID NO: 18935 - DNA, 23 bp, Artificial Sequence
  Synthetic
ccgttttttttttttccatagaa

SEQ ID NO: 18936 - DNA, 23 bp, Artificial Sequence
  Synthetic
ccgttttttttttttgaaatttc

SEQ ID NO: 18937 - DNA, 23 bp, Artificial Sequence
  Synthetic
ccgttttttttttttaaaagttg

SEQ ID NO: 18938 - DNA, 23 bp, Artificial Sequence
  Synthetic
ccgttttttttttttacaggacc

SEQ ID NO: 18939 - DNA, 23 bp, Artificial Sequence
  Synthetic
ccgttttttttttttacgttcca

SEQ ID NO: 18940 - DNA, 23 bp, Artificial Sequence
  Synthetic
ccgttttttttttttgatgtgga

SEQ ID NO: 18941 - DNA, 23 bp, Artificial Sequence
  Synthetic
ccgttttttttttttgcatgttc

SEQ ID NO: 18942 - DNA, 23 bp, Artificial Sequence
  Synthetic
ccgttttttttttttagagagct

SEQ ID NO: 18943 - DNA, 23 bp, Artificial Sequence
  Synthetic
ccgttttttttttttaatccacc

SEQ ID NO: 18944 - DNA, 23 bp, Artificial Sequence
  Synthetic
ccgttttttttttttccacagtc

SEQ ID NO: 18945 - DNA, 23 bp, Artificial Sequence
  Synthetic
ccgttttttttttttaacaattt

SEQ ID NO: 18946 - DNA, 23 bp, Artificial Sequence
  Synthetic
ccgttttttttttttggggttca

SEQ ID NO: 18947 - DNA, 23 bp, Artificial Sequence
  Synthetic
ccgttttttttttttcaggccat

SEQ ID NO: 18948 - DNA, 23 bp, Artificial Sequence
  Synthetic
ccgttttttttttttgagggtta

SEQ ID NO: 18949 - DNA, 23 bp, Artificial Sequence
  Synthetic
ccgttttttttttttggctagtg

SEQ ID NO: 18950 - DNA, 23 bp, Artificial Sequence
  Synthetic
ccgttttttttttttccttctga

SEQ ID NO: 18951 - DNA, 23 bp, Artificial Sequence
  Synthetic
ccgttttttttttttaggggcct

SEQ ID NO: 18952 - DNA, 23 bp, Artificial Sequence
  Synthetic
ccgttttttttttttaaaacatg

SEQ ID NO: 18953 - DNA, 23 bp, Artificial Sequence
  Synthetic
ccgttttttttttttcggacacg

SEQ ID NO: 18954 - DNA, 23 bp, Artificial Sequence
  Synthetic
ccgttttttttttttggcattac

SEQ ID NO: 18955 - DNA, 23 bp, Artificial Sequence
  Synthetic
ccgttttttttttttgcatgacg

SEQ ID NO: 18956 - DNA, 23 bp, Artificial Sequence
  Synthetic
ccgttttttttttttaccgagga

SEQ ID NO: 18957 - DNA, 23 bp, Artificial Sequence
  Synthetic
ccgttttttttttttataatgac

SEQ ID NO: 18958 - DNA, 23 bp, Artificial Sequence
  Synthetic
ccgttttttttttttagtcgagt

SEQ ID NO: 18959 - DNA, 23 bp, Artificial Sequence
  Synthetic
ccgttttttttttttcaaaccat

SEQ ID NO: 18960 - DNA, 23 bp, Artificial Sequence
  Synthetic
ccgttttttttttttggacatcc

SEQ ID NO: 18961 - DNA, 23 bp, Artificial Sequence
  Synthetic
ccgttttttttttttcagctaac

SEQ ID NO: 18962 - DNA, 23 bp, Artificial Sequence
  Synthetic
ccgttttttttttttagctagca

SEQ ID NO: 18963 - DNA, 23 bp, Artificial Sequence
  Synthetic
ccgttttttttttttggaacaca

SEQ ID NO: 18964 - DNA, 23 bp, Artificial Sequence
  Synthetic
ccgttttttttttttaggaacat

SEQ ID NO: 18965 - DNA, 23 bp, Artificial Sequence
  Synthetic
ccgttttttttttttcatgcaaa

SEQ ID NO: 18966 - DNA, 23 bp, Artificial Sequence
  Synthetic
ccgttttttttttttctcagtaa

SEQ ID NO: 18967 - DNA, 23 bp, Artificial Sequence
  Synthetic
ccgttttttttttttcagtttcc

SEQ ID NO: 18968 - DNA, 23 bp, Artificial Sequence
  Synthetic
ccgttttttttttttgtatatgc

SEQ ID NO: 18969 - DNA, 23 bp, Artificial Sequence
  Synthetic
ccgttttttttttttatgtagtc

SEQ ID NO: 18970 - DNA, 23 bp, Artificial Sequence
  Synthetic
ccgttttttttttttggacaaca

SEQ ID NO: 18971 - DNA, 23 bp, Artificial Sequence
  Synthetic
ccgttttttttttttcacagaat

SEQ ID NO: 18972 - DNA, 23 bp, Artificial Sequence
  Synthetic
ccgttttttttttttcatcagtg

SEQ ID NO: 18973 - DNA, 23 bp, Artificial Sequence
  Synthetic
ccgttttttttttttatgtgtgc

SEQ ID NO: 18974 - DNA, 23 bp, Artificial Sequence
  Synthetic
ccgttttttttttttatacatgc

SEQ ID NO: 18975 - DNA, 23 bp, Artificial Sequence
  Synthetic
ccgttttttttttttaggtgtgt

SEQ ID NO: 18976 - DNA, 23 bp, Artificial Sequence
  Synthetic
ccgttttttttttttggtgtgtg

SEQ ID NO: 18977 - DNA, 23 bp, Artificial Sequence
  Synthetic
ccgttttttttttttgacacacg

SEQ ID NO: 18978 - DNA, 23 bp, Artificial Sequence
  Synthetic
ccgttttttttttttacaccaag

SEQ ID NO: 18979 - DNA, 23 bp, Artificial Sequence
  Synthetic
ccgttttttttttttccagtgcc

SEQ ID NO: 18980 - DNA, 23 bp, Artificial Sequence
  Synthetic
ccgttttttttttttaaaagcac

SEQ ID NO: 18981 - DNA, 23 bp, Artificial Sequence
  Synthetic
ccgttttttttttttaagacggg

SEQ ID NO: 18982 - DNA, 23 bp, Artificial Sequence
  Synthetic
ccgttttttttttttgggagggg

SEQ ID NO: 18983 - DNA, 23 bp, Artificial Sequence
  Synthetic
ccgttttttttttttgaggagag

SEQ ID NO: 18984 - DNA, 23 bp, Artificial Sequence
  Synthetic
ccgttttttttttttattcatca

SEQ ID NO: 18985 - DNA, 23 bp, Artificial Sequence
  Synthetic
ccgttttttttttttggggcagc

SEQ ID NO: 18986 - DNA, 23 bp, Artificial Sequence
  Synthetic
ccgttttttttttttggatgacc

SEQ ID NO: 18987 - DNA, 23 bp, Artificial Sequence
  Synthetic
ccgttttttttttttgagtgcta

SEQ ID NO: 18988 - DNA, 23 bp, Artificial Sequence
  Synthetic
ccgttttttttttttccaagaaa

SEQ ID NO: 18989 - DNA, 23 bp, Artificial Sequence
  Synthetic
ccgttttttttttttgccatata

SEQ ID NO: 18990 - DNA, 23 bp, Artificial Sequence
  Synthetic
ccgttttttttttttgcatggag

SEQ ID NO: 18991 - DNA, 23 bp, Artificial Sequence
  Synthetic
ccgttttttttttttcatggaag

SEQ ID NO: 18992 - DNA, 23 bp, Artificial Sequence
  Synthetic
ccgttttttttttttgtttcccg

SEQ ID NO: 18993 - DNA, 23 bp, Artificial Sequence
  Synthetic
ccgttttttttttttgaagtgca

SEQ ID NO: 18994 - DNA, 23 bp, Artificial Sequence
  Synthetic
ccgttttttttttttgattggcc

SEQ ID NO: 18995 - DNA, 23 bp, Artificial Sequence
  Synthetic
ccgttttttttttttaaaccaca

SEQ ID NO: 18996 - DNA, 23 bp, Artificial Sequence
  Synthetic
ccgttttttttttttacatcact

SEQ ID NO: 18997 - DNA, 23 bp, Artificial Sequence
  Synthetic
ccgttttttttttttaacccttg

SEQ ID NO: 18998 - DNA, 23 bp, Artificial Sequence
  Synthetic
ccgttttttttttttcccaggga

SEQ ID NO: 18999 - DNA, 23 bp, Artificial Sequence
  Synthetic
ccgttttttttttttaatccttg

SEQ ID NO: 19000 - DNA, 23 bp, Artificial Sequence
  Synthetic
ccgttttttttttttagtactgt

SEQ ID NO: 19001 - DNA, 23 bp, Artificial Sequence
  Synthetic
ccgttttttttttttaaaaccag

SEQ ID NO: 19002 - DNA, 23 bp, Artificial Sequence
  Synthetic
ccgttttttttttttggtcctac

SEQ ID NO: 19003 - DNA, 23 bp, Artificial Sequence
  Synthetic
ccgttttttttttttacaccaag

SEQ ID NO: 19004 - DNA, 23 bp, Artificial Sequence
  Synthetic
ccgttttttttttttaggatcga

SEQ ID NO: 19005 - DNA, 23 bp, Artificial Sequence
  Synthetic
ccgttttttttttttaccaacat

SEQ ID NO: 19006 - DNA, 23 bp, Artificial Sequence
  Synthetic
ccgttttttttttttgttatcaa

SEQ ID NO: 19007 - DNA, 23 bp, Artificial Sequence
  Synthetic
ccgttttttttttttgacatgat

SEQ ID NO: 19008 - DNA, 23 bp, Artificial Sequence
  Synthetic
ccgttttttttttttaagtgcac

SEQ ID NO: 19009 - DNA, 23 bp, Artificial Sequence
  Synthetic
ccgttttttttttttctccgtgc

SEQ ID NO: 19010 - DNA, 23 bp, Artificial Sequence
  Synthetic
ccgttttttttttttctcaaaga

SEQ ID NO: 19011 - DNA, 23 bp, Artificial Sequence
  Synthetic
ccgttttttttttttctgaaacc

SEQ ID NO: 19012 - DNA, 23 bp, Artificial Sequence
  Synthetic
ccgttttttttttttatcatcgc

SEQ ID NO: 19013 - DNA, 23 bp, Artificial Sequence
  Synthetic
ccgttttttttttttgagggaga

SEQ ID NO: 19014 - DNA, 23 bp, Artificial Sequence
  Synthetic
ccgttttttttttttacaaccct

SEQ ID NO: 19015 - DNA, 23 bp, Artificial Sequence
  Synthetic
ccgttttttttttttgggacctc

SEQ ID NO: 19016 - DNA, 23 bp, Artificial Sequence
  Synthetic
ccgttttttttttttctctcaca

SEQ ID NO: 19017 - DNA, 23 bp, Artificial Sequence
  Synthetic
ccgttttttttttttggctgggt

SEQ ID NO: 19018 - DNA, 23 bp, Artificial Sequence
  Synthetic
ccgttttttttttttagtgggcc

SEQ ID NO: 19019 - DNA, 23 bp, Artificial Sequence
  Synthetic
ccgttttttttttttatgaacat

SEQ ID NO: 19020 - DNA, 23 bp, Artificial Sequence
  Synthetic
ccgttttttttttttatgcacat

SEQ ID NO: 19021 - DNA, 23 bp, Artificial Sequence
  Synthetic
ccgttttttttttttacacatcc

SEQ ID NO: 19022 - DNA, 23 bp, Artificial Sequence
  Synthetic
ccgttttttttttttccacatac

SEQ ID NO: 19023 - DNA, 23 bp, Artificial Sequence
  Synthetic
ccgttttttttttttccagcccc

SEQ ID NO: 19024 - DNA, 23 bp, Artificial Sequence
  Synthetic
ccgttttttttttttcacacagt

SEQ ID NO: 19025 - DNA, 23 bp, Artificial Sequence
  Synthetic
ccgttttttttttttcaaggacc

SEQ ID NO: 19026 - DNA, 23 bp, Artificial Sequence
  Synthetic
ccgttttttttttttaccactcc

SEQ ID NO: 19027 - DNA, 23 bp, Artificial Sequence
  Synthetic
ccgttttttttttttgagatggg

SEQ ID NO: 19028 - DNA, 23 bp, Artificial Sequence
  Synthetic
ccgttttttttttttgagcggtt

SEQ ID NO: 19029 - DNA, 23 bp, Artificial Sequence
  Synthetic
ccgttttttttttttgtgggccc

SEQ ID NO: 19030 - DNA, 23 bp, Artificial Sequence
  Synthetic
ccgttttttttttttctcaacaa

SEQ ID NO: 19031 - DNA, 23 bp, Artificial Sequence
  Synthetic
ccgttttttttttttaagtccta

SEQ ID NO: 19032 - DNA, 23 bp, Artificial Sequence
  Synthetic
ccgttttttttttttgaagctaa

SEQ ID NO: 19033 - DNA, 23 bp, Artificial Sequence
  Synthetic
ccgttttttttttttccagtcct

SEQ ID NO: 19034 - DNA, 23 bp, Artificial Sequence
  Synthetic
ccgttttttttttttcaagagtc

SEQ ID NO: 19035 - DNA, 23 bp, Artificial Sequence
  Synthetic
ccgttttttttttttcccatgtc

SEQ ID NO: 19036 - DNA, 23 bp, Artificial Sequence
  Synthetic
ccgttttttttttttctgcctgc

SEQ ID NO: 19037 - DNA, 23 bp, Artificial Sequence
  Synthetic
ccgttttttttttttgacttcac

SEQ ID NO: 19038 - DNA, 23 bp, Artificial Sequence
  Synthetic
ccgttttttttttttggacacag

SEQ ID NO: 19039 - DNA, 23 bp, Artificial Sequence
  Synthetic
ccgttttttttttttcttgaagg

SEQ ID NO: 19040 - DNA, 23 bp, Artificial Sequence
  Synthetic
ccgttttttttttttcctcacct

SEQ ID NO: 19041 - DNA, 23 bp, Artificial Sequence
  Synthetic
ccgttttttttttttaccgtctg

SEQ ID NO: 19042 - DNA, 23 bp, Artificial Sequence
  Synthetic
ccgttttttttttttgctgcatt

SEQ ID NO: 19043 - DNA, 23 bp, Artificial Sequence
  Synthetic
ccgttttttttttttataagtag

SEQ ID NO: 19044 - DNA, 23 bp, Artificial Sequence
  Synthetic
ccgttttttttttttaccccgcc

SEQ ID NO: 19045 - DNA, 23 bp, Artificial Sequence
  Synthetic
ccgttttttttttttgtgagcct

SEQ ID NO: 19046 - DNA, 23 bp, Artificial Sequence
  Synthetic
ccgttttttttttttcctctctt

SEQ ID NO: 19047 - DNA, 23 bp, Artificial Sequence
  Synthetic
ccgttttttttttttgtgaggcg

SEQ ID NO: 19048 - DNA, 23 bp, Artificial Sequence
  Synthetic
ccgttttttttttttagccacat

SEQ ID NO: 19049 - DNA, 23 bp, Artificial Sequence
  Synthetic
ccgttttttttttttaaactttc

SEQ ID NO: 19050 - DNA, 23 bp, Artificial Sequence
  Synthetic
ccgttttttttttttaggcaaca

SEQ ID NO: 19051 - DNA, 23 bp, Artificial Sequence
  Synthetic
ccgttttttttttttgtcaccta

SEQ ID NO: 19052 - DNA, 23 bp, Artificial Sequence
  Synthetic
ccgttttttttttttcacagcaa

SEQ ID NO: 19053 - DNA, 23 bp, Artificial Sequence
  Synthetic
ccgttttttttttttcacaggac

SEQ ID NO: 19054 - DNA, 23 bp, Artificial Sequence
  Synthetic
ccgttttttttttttggaaggaa

SEQ ID NO: 19055 - DNA, 23 bp, Artificial Sequence
  Synthetic
ccgttttttttttttagccaggt

SEQ ID NO: 19056 - DNA, 23 bp, Artificial Sequence
  Synthetic
ccgttttttttttttacaaaatc

SEQ ID NO: 19057 - DNA, 23 bp, Artificial Sequence
  Synthetic
ccgttttttttttttggactcgg

SEQ ID NO: 19058 - DNA, 23 bp, Artificial Sequence
  Synthetic
ccgttttttttttttatctattt

SEQ ID NO: 19059 - DNA, 23 bp, Artificial Sequence
  Synthetic
ccgttttttttttttgcggggta

SEQ ID NO: 19060 - DNA, 23 bp, Artificial Sequence
  Synthetic
ccgttttttttttttcttctgaa

SEQ ID NO: 19061 - DNA, 23 bp, Artificial Sequence
  Synthetic
ccgttttttttttttggagcaga

SEQ ID NO: 19062 - DNA, 23 bp, Artificial Sequence
  Synthetic
ccgttttttttttttccacccca

SEQ ID NO: 19063 - DNA, 23 bp, Artificial Sequence
  Synthetic
ccgttttttttttttgacagggt

SEQ ID NO: 19064 - DNA, 23 bp, Artificial Sequence
  Synthetic
ccgttttttttttttaggcaagc

SEQ ID NO: 19065 - DNA, 23 bp, Artificial Sequence
  Synthetic
ccgttttttttttttaagctcac

SEQ ID NO: 19066 - DNA, 23 bp, Artificial Sequence
  Synthetic
ccgttttttttttttcctgcctc

SEQ ID NO: 19067 - DNA, 23 bp, Artificial Sequence
  Synthetic
ccgttttttttttttaactctcc

SEQ ID NO: 19068 - DNA, 23 bp, Artificial Sequence
  Synthetic
ccgttttttttttttcatctctc

SEQ ID NO: 19069 - DNA, 23 bp, Artificial Sequence
  Synthetic
ccgttttttttttttaccgcccg

SEQ ID NO: 19070 - DNA, 23 bp, Artificial Sequence
  Synthetic
ccgttttttttttttacacccgg

SEQ ID NO: 19071 - DNA, 23 bp, Artificial Sequence
  Synthetic
ccgttttttttttttgtgtgcct

SEQ ID NO: 19072 - DNA, 23 bp, Artificial Sequence
  Synthetic
ccgttttttttttttgaccgacc

SEQ ID NO: 19073 - DNA, 23 bp, Artificial Sequence
  Synthetic
ccgttttttttttttcgcggggg

SEQ ID NO: 19074 - DNA, 23 bp, Artificial Sequence
  Synthetic
ccgttttttttttttagaaggta

SEQ ID NO: 19075 - DNA, 23 bp, Artificial Sequence
  Synthetic
ccgttttttttttttacacccgg

SEQ ID NO: 19076 - DNA, 23 bp, Artificial Sequence
  Synthetic
ccgttttttttttttcatttttc

SEQ ID NO: 19077 - DNA, 23 bp, Artificial Sequence
  Synthetic
ccgttttttttttttaggcccca

SEQ ID NO: 19078 - DNA, 23 bp, Artificial Sequence
  Synthetic
ccgttttttttttttccctttta

SEQ ID NO: 19079 - DNA, 23 bp, Artificial Sequence
  Synthetic
ccgttttttttttttgttagccc

SEQ ID NO: 19080 - DNA, 23 bp, Artificial Sequence
  Synthetic
ccgttttttttttttggaccagg

SEQ ID NO: 19081 - DNA, 23 bp, Artificial Sequence
  Synthetic
ccgttttttttttttaaaattgt

SEQ ID NO: 19082 - DNA, 23 bp, Artificial Sequence
  Synthetic
ccgttttttttttttcccacaga

SEQ ID NO: 19083 - DNA, 23 bp, Artificial Sequence
  Synthetic
ccgttttttttttttcagtttca

SEQ ID NO: 19084 - DNA, 23 bp, Artificial Sequence
  Synthetic
ccgttttttttttttctgtcccg

SEQ ID NO: 19085 - DNA, 23 bp, Artificial Sequence
  Synthetic
ccgttttttttttttcactggtt

SEQ ID NO: 19086 - DNA, 23 bp, Artificial Sequence
  Synthetic
ccgttttttttttttagttgcca

SEQ ID NO: 19087 - DNA, 23 bp, Artificial Sequence
  Synthetic
ccgttttttttttttgaggacat

SEQ ID NO: 19088 - DNA, 23 bp, Artificial Sequence
  Synthetic
ccgttttttttttttagctccac

SEQ ID NO: 19089 - DNA, 23 bp, Artificial Sequence
  Synthetic
ccgttttttttttttcaaaatca

SEQ ID NO: 19090 - DNA, 23 bp, Artificial Sequence
  Synthetic
ccgttttttttttttgattccgc

SEQ ID NO: 19091 - DNA, 23 bp, Artificial Sequence
  Synthetic
ccgttttttttttttggatgaat

SEQ ID NO: 19092 - DNA, 23 bp, Artificial Sequence
  Synthetic
ccgttttttttttttaggtgagg

SEQ ID NO: 19093 - DNA, 23 bp, Artificial Sequence
  Synthetic
ccgttttttttttttctatgtcc

SEQ ID NO: 19094 - DNA, 23 bp, Artificial Sequence
  Synthetic
ccgttttttttttttacagctag

SEQ ID NO: 19095 - DNA, 23 bp, Artificial Sequence
  Synthetic
ccgttttttttttttcggttatc

SEQ ID NO: 19096 - DNA, 23 bp, Artificial Sequence
  Synthetic
ccgttttttttttttggccggga

SEQ ID NO: 19097 - DNA, 23 bp, Artificial Sequence
  Synthetic
ccgttttttttttttcctgcacg

SEQ ID NO: 19098 - DNA, 23 bp, Artificial Sequence
  Synthetic
ccgttttttttttttcaaaaatg

SEQ ID NO: 19099 - DNA, 23 bp, Artificial Sequence
  Synthetic
ccgttttttttttttcaatacaa

SEQ ID NO: 19100 - DNA, 23 bp, Artificial Sequence
  Synthetic
ccgttttttttttttaagatcgg

SEQ ID NO: 19101 - DNA, 23 bp, Artificial Sequence
  Synthetic
ccgttttttttttttcaaggtcg

SEQ ID NO: 19102 - DNA, 23 bp, Artificial Sequence
  Synthetic
ccgttttttttttttagttatca

SEQ ID NO: 19103 - DNA, 23 bp, Artificial Sequence
  Synthetic
ccgttttttttttttagccctgt

SEQ ID NO: 19104 - DNA, 23 bp, Artificial Sequence
  Synthetic
ccgttttttttttttaggagtct

SEQ ID NO: 19105 - DNA, 23 bp, Artificial Sequence
  Synthetic
ccgttttttttttttacctgcac

SEQ ID NO: 19106 - DNA, 23 bp, Artificial Sequence
  Synthetic
ccgttttttttttttgcactgtc

SEQ ID NO: 19107 - DNA, 23 bp, Artificial Sequence
  Synthetic
ccgttttttttttttagccctgt

SEQ ID NO: 19108 - DNA, 23 bp, Artificial Sequence
  Synthetic
ccgttttttttttttaaattcgg

SEQ ID NO: 19109 - DNA, 23 bp, Artificial Sequence
  Synthetic
ccgttttttttttttcaagttag

SEQ ID NO: 19110 - DNA, 23 bp, Artificial Sequence
  Synthetic
ccgttttttttttttccaagctc

SEQ ID NO: 19111 - DNA, 23 bp, Artificial Sequence
  Synthetic
ccgttttttttttttccttttaa

SEQ ID NO: 19112 - DNA, 23 bp, Artificial Sequence
  Synthetic
ccgttttttttttttagctggtt

SEQ ID NO: 19113 - DNA, 23 bp, Artificial Sequence
  Synthetic
ccgttttttttttttctctggtc

SEQ ID NO: 19114 - DNA, 23 bp, Artificial Sequence
  Synthetic
ccgttttttttttttccataggg

SEQ ID NO: 19115 - DNA, 23 bp, Artificial Sequence
  Synthetic
ccgttttttttttttgtacatca

SEQ ID NO: 19116 - DNA, 23 bp, Artificial Sequence
  Synthetic
ccgttttttttttttgggattcc

SEQ ID NO: 19117 - DNA, 23 bp, Artificial Sequence
  Synthetic
ccgttttttttttttagaagcat

SEQ ID NO: 19118 - DNA, 23 bp, Artificial Sequence
  Synthetic
ccgttttttttttttcttttgtg

SEQ ID NO: 19119 - DNA, 23 bp, Artificial Sequence
  Synthetic
ccgttttttttttttaaggcaac

SEQ ID NO: 19120 - DNA, 23 bp, Artificial Sequence
  Synthetic
ccgttttttttttttcaaaccat

SEQ ID NO: 19121 - DNA, 23 bp, Artificial Sequence
  Synthetic
ccgttttttttttttaaccatga

SEQ ID NO: 19122 - DNA, 23 bp, Artificial Sequence
  Synthetic
ccgttttttttttttccaatatt

SEQ ID NO: 19123 - DNA, 23 bp, Artificial Sequence
  Synthetic
ccgttttttttttttaagtgcct

SEQ ID NO: 19124 - DNA, 23 bp, Artificial Sequence
  Synthetic
ccgttttttttttttacctgcac

SEQ ID NO: 19125 - DNA, 23 bp, Artificial Sequence
  Synthetic
ccgttttttttttttgcactaga

SEQ ID NO: 19126 - DNA, 23 bp, Artificial Sequence
  Synthetic
ccgttttttttttttcaccgaca

SEQ ID NO: 19127 - DNA, 23 bp, Artificial Sequence
  Synthetic
ccgttttttttttttacaatcaa

SEQ ID NO: 19128 - DNA, 23 bp, Artificial Sequence
  Synthetic
ccgttttttttttttcccaccga

SEQ ID NO: 19129 - DNA, 23 bp, Artificial Sequence
  Synthetic
ccgttttttttttttgtgaattc

SEQ ID NO: 19130 - DNA, 23 bp, Artificial Sequence
  Synthetic
ccgttttttttttttccttatca

SEQ ID NO: 19131 - DNA, 23 bp, Artificial Sequence
  Synthetic
ccgttttttttttttgctgcaac

SEQ ID NO: 19132 - DNA, 23 bp, Artificial Sequence
  Synthetic
ccgttttttttttttcctccacc

SEQ ID NO: 19133 - DNA, 23 bp, Artificial Sequence
  Synthetic
ccgttttttttttttgatatcag

SEQ ID NO: 19134 - DNA, 23 bp, Artificial Sequence
  Synthetic
ccgttttttttttttacatggag

SEQ ID NO: 19135 - DNA, 23 bp, Artificial Sequence
  Synthetic
ccgttttttttttttcgggtgga

SEQ ID NO: 19136 - DNA, 23 bp, Artificial Sequence
  Synthetic
ccgttttttttttttatttcccc

SEQ ID NO: 19137 - DNA, 23 bp, Artificial Sequence
  Synthetic
ccgttttttttttttacaggtag

SEQ ID NO: 19138 - DNA, 23 bp, Artificial Sequence
  Synthetic
ccgttttttttttttgttttgca

SEQ ID NO: 19139 - DNA, 23 bp, Artificial Sequence
  Synthetic
ccgttttttttttttgttttgca

SEQ ID NO: 19140 - DNA, 23 bp, Artificial Sequence
  Synthetic
ccgttttttttttttctgcacta

SEQ ID NO: 19141 - DNA, 23 bp, Artificial Sequence
  Synthetic
ccgttttttttttttgcatagga

SEQ ID NO: 19142 - DNA, 23 bp, Artificial Sequence
  Synthetic
ccgttttttttttttgactccgg

SEQ ID NO: 19143 - DNA, 23 bp, Artificial Sequence
  Synthetic
ccgttttttttttttacacactt

SEQ ID NO: 19144 - DNA, 23 bp, Artificial Sequence
  Synthetic
ccgttttttttttttacatcagt

SEQ ID NO: 19145 - DNA, 23 bp, Artificial Sequence
  Synthetic
ccgttttttttttttgcgaagga

SEQ ID NO: 19146 - DNA, 23 bp, Artificial Sequence
  Synthetic
ccgttttttttttttcctgtctg

SEQ ID NO: 19147 - DNA, 23 bp, Artificial Sequence
  Synthetic
ccgttttttttttttgtcaattc

SEQ ID NO: 19148 - DNA, 23 bp, Artificial Sequence
  Synthetic
ccgttttttttttttatggttag

SEQ ID NO: 19149 - DNA, 23 bp, Artificial Sequence
  Synthetic
ccgttttttttttttagttcttc

SEQ ID NO: 19150 - DNA, 23 bp, Artificial Sequence
  Synthetic
ccgttttttttttttagtgtcag

SEQ ID NO: 19151 - DNA, 23 bp, Artificial Sequence
  Synthetic
ccgttttttttttttacggaacc

SEQ ID NO: 19152 - DNA, 23 bp, Artificial Sequence
  Synthetic
ccgttttttttttttaaatccct

SEQ ID NO: 19153 - DNA, 23 bp, Artificial Sequence
  Synthetic
ccgttttttttttttcctgctga

SEQ ID NO: 19154 - DNA, 23 bp, Artificial Sequence
  Synthetic
ccgttttttttttttgaccgaga

SEQ ID NO: 19155 - DNA, 23 bp, Artificial Sequence
  Synthetic
ccgttttttttttttcctatcct

SEQ ID NO: 19156 - DNA, 23 bp, Artificial Sequence
  Synthetic
ccgttttttttttttcggaactt

SEQ ID NO: 19157 - DNA, 23 bp, Artificial Sequence
  Synthetic
ccgttttttttttttaatagact

SEQ ID NO: 19158 - DNA, 23 bp, Artificial Sequence
  Synthetic
ccgttttttttttttccgatttc

SEQ ID NO: 19159 - DNA, 23 bp, Artificial Sequence
  Synthetic
ccgttttttttttttgatttcaa

SEQ ID NO: 19160 - DNA, 23 bp, Artificial Sequence
  Synthetic
ccgttttttttttttgagtgtag

SEQ ID NO: 19161 - DNA, 23 bp, Artificial Sequence
  Synthetic
ccgttttttttttttgagagtgt

SEQ ID NO: 19162 - DNA, 23 bp, Artificial Sequence
  Synthetic
ccgttttttttttttcagtcggg

SEQ ID NO: 19163 - DNA, 23 bp, Artificial Sequence
  Synthetic
ccgttttttttttttgctatgcc

SEQ ID NO: 19164 - DNA, 23 bp, Artificial Sequence
  Synthetic
ccgttttttttttttaacttagt

SEQ ID NO: 19165 - DNA, 23 bp, Artificial Sequence
  Synthetic
ccgttttttttttttatgcaact

SEQ ID NO: 19166 - DNA, 23 bp, Artificial Sequence
  Synthetic
ccgttttttttttttaaccagct

SEQ ID NO: 19167 - DNA, 23 bp, Artificial Sequence
  Synthetic
ccgttttttttttttcaaaatca

SEQ ID NO: 19168 - DNA, 23 bp, Artificial Sequence
  Synthetic
ccgttttttttttttacagctag

SEQ ID NO: 19169 - DNA, 23 bp, Artificial Sequence
  Synthetic
ccgttttttttttttaggccggg

SEQ ID NO: 19170 - DNA, 23 bp, Artificial Sequence
  Synthetic
ccgttttttttttttcctgcacg

SEQ ID NO: 19171 - DNA, 23 bp, Artificial Sequence
  Synthetic
ccgttttttttttttaaaaatgt

SEQ ID NO: 19172 - DNA, 23 bp, Artificial Sequence
  Synthetic
ccgttttttttttttcaagatcg

SEQ ID NO: 19173 - DNA, 23 bp, Artificial Sequence
  Synthetic
ccgttttttttttttctctctct

SEQ ID NO: 19174 - DNA, 23 bp, Artificial Sequence
  Synthetic
ccgttttttttttttcatacagg

SEQ ID NO: 19175 - DNA, 23 bp, Artificial Sequence
  Synthetic
ccgttttttttttttgatgcaga

SEQ ID NO: 19176 - DNA, 23 bp, Artificial Sequence
  Synthetic
ccgttttttttttttggaatgaa

SEQ ID NO: 19177 - DNA, 23 bp, Artificial Sequence
  Synthetic
ccgttttttttttttgcaagtca

SEQ ID NO: 19178 - DNA, 23 bp, Artificial Sequence
  Synthetic
ccgttttttttttttgcaagtca

SEQ ID NO: 19179 - DNA, 23 bp, Artificial Sequence
  Synthetic
ccgttttttttttttattggcac

SEQ ID NO: 19180 - DNA, 23 bp, Artificial Sequence
  Synthetic
ccgttttttttttttgagctccc

SEQ ID NO: 19181 - DNA, 23 bp, Artificial Sequence
  Synthetic
ccgttttttttttttcaatgcga

SEQ ID NO: 19182 - DNA, 23 bp, Artificial Sequence
  Synthetic
ccgttttttttttttgttccccc

SEQ ID NO: 19183 - DNA, 23 bp, Artificial Sequence
  Synthetic
ccgttttttttttttgttccccc

SEQ ID NO: 19184 - DNA, 23 bp, Artificial Sequence
  Synthetic
ccgttttttttttttgttccccc

SEQ ID NO: 19185 - DNA, 23 bp, Artificial Sequence
  Synthetic
ccgttttttttttttgttccccc

SEQ ID NO: 19186 - DNA, 23 bp, Artificial Sequence
  Synthetic
ccgttttttttttttgttccccc

SEQ ID NO: 19187 - DNA, 23 bp, Artificial Sequence
  Synthetic
ccgttttttttttttgttccccc

SEQ ID NO: 19188 - DNA, 23 bp, Artificial Sequence
  Synthetic
ccgttttttttttttgttccccc

SEQ ID NO: 19189 - DNA, 23 bp, Artificial Sequence
  Synthetic
ccgttttttttttttgttccccc

SEQ ID NO: 19190 - DNA, 23 bp, Artificial Sequence
  Synthetic
ccgttttttttttttgttccccc

SEQ ID NO: 19191 - DNA, 23 bp, Artificial Sequence
  Synthetic
ccgttttttttttttgttccccc

SEQ ID NO: 19192 - DNA, 23 bp, Artificial Sequence
  Synthetic
ccgttttttttttttgttccccc

SEQ ID NO: 19193 - DNA, 23 bp, Artificial Sequence
  Synthetic
ccgttttttttttttgttccccc

SEQ ID NO: 19194 - DNA, 23 bp, Artificial Sequence
  Synthetic
ccgttttttttttttgttccccc

SEQ ID NO: 19195 - DNA, 23 bp, Artificial Sequence
  Synthetic
ccgttttttttttttgttccccc

SEQ ID NO: 19196 - DNA, 23 bp, Artificial Sequence
  Synthetic
ccgttttttttttttgttccccc

SEQ ID NO: 19197 - DNA, 23 bp, Artificial Sequence
  Synthetic
ccgttttttttttttgttccccc

SEQ ID NO: 19198 - DNA, 23 bp, Artificial Sequence
  Synthetic
ccgttttttttttttggcaaatc

SEQ ID NO: 19199 - DNA, 23 bp, Artificial Sequence
  Synthetic
ccgttttttttttttgggcagct

SEQ ID NO: 19200 - DNA, 23 bp, Artificial Sequence
  Synthetic
ccgttttttttttttgggcaaat

SEQ ID NO: 19201 - DNA, 23 bp, Artificial Sequence
  Synthetic
ccgttttttttttttggcagctc

SEQ ID NO: 19202 - DNA, 23 bp, Artificial Sequence
  Synthetic
ccgttttttttttttggcaaatc

SEQ ID NO: 19203 - DNA, 23 bp, Artificial Sequence
  Synthetic
ccgttttttttttttccaagctc

SEQ ID NO: 19204 - DNA, 23 bp, Artificial Sequence
  Synthetic
ccgttttttttttttatcatcaa

SEQ ID NO: 19205 - DNA, 23 bp, Artificial Sequence
  Synthetic
ccgttttttttttttgcatgacg

SEQ ID NO: 19206 - DNA, 23 bp, Artificial Sequence
  Synthetic
ccgttttttttttttacccaatg

SEQ ID NO: 19207 - DNA, 23 bp, Artificial Sequence
  Synthetic
ccgttttttttttttctcactct

SEQ ID NO: 19208 - DNA, 23 bp, Artificial Sequence
  Synthetic
ccgttttttttttttctcactct

SEQ ID NO: 19209 - DNA, 23 bp, Artificial Sequence
  Synthetic
ccgttttttttttttctcactct

SEQ ID NO: 19210 - DNA, 23 bp, Artificial Sequence
  Synthetic
ccgttttttttttttctcactct

SEQ ID NO: 19211 - DNA, 23 bp, Artificial Sequence
  Synthetic
ccgttttttttttttctcactct

SEQ ID NO: 19212 - DNA, 23 bp, Artificial Sequence
  Synthetic
ccgttttttttttttctcactct

SEQ ID NO: 19213 - DNA, 23 bp, Artificial Sequence
  Synthetic
ccgttttttttttttctcactct

SEQ ID NO: 19214 - DNA, 23 bp, Artificial Sequence
  Synthetic
ccgttttttttttttctcactct

SEQ ID NO: 19215 - DNA, 23 bp, Artificial Sequence
  Synthetic
ccgttttttttttttctcactct

SEQ ID NO: 19216 - DNA, 23 bp, Artificial Sequence
  Synthetic
ccgttttttttttttctcactct

SEQ ID NO: 19217 - DNA, 23 bp, Artificial Sequence
  Synthetic
ccgttttttttttttctctctct

SEQ ID NO: 19218 - DNA, 23 bp, Artificial Sequence
  Synthetic
ccgttttttttttttctcactct

SEQ ID NO: 19219 - DNA, 23 bp, Artificial Sequence
  Synthetic
ccgttttttttttttgagctccc

SEQ ID NO: 19220 - DNA, 23 bp, Artificial Sequence
  Synthetic
ccgttttttttttttgagctccc

SEQ ID NO: 19221 - DNA, 23 bp, Artificial Sequence
  Synthetic
ccgttttttttttttagctccct

SEQ ID NO: 19222 - DNA, 23 bp, Artificial Sequence
  Synthetic
ccgttttttttttttgagctccc

SEQ ID NO: 19223 - DNA, 23 bp, Artificial Sequence
  Synthetic
ccgttttttttttttgagctccc

SEQ ID NO: 19224 - DNA, 23 bp, Artificial Sequence
  Synthetic
ccgttttttttttttagctccct

SEQ ID NO: 19225 - DNA, 23 bp, Artificial Sequence
  Synthetic
ccgttttttttttttcatacagg

SEQ ID NO: 19226 - DNA, 23 bp, Artificial Sequence
  Synthetic
ccgttttttttttttcatacagg

SEQ ID NO: 19227 - DNA, 23 bp, Artificial Sequence
  Synthetic
ccgttttttttttttcatacagg

SEQ ID NO: 19228 - DNA, 23 bp, Artificial Sequence
  Synthetic
ccgttttttttttttcatacagg

SEQ ID NO: 19229 - DNA, 23 bp, Artificial Sequence
  Synthetic
ccgttttttttttttgcatacag

SEQ ID NO: 19230 - DNA, 23 bp, Artificial Sequence
  Synthetic
ccgttttttttttttcattcagg

SEQ ID NO: 19231 - DNA, 23 bp, Artificial Sequence
  Synthetic
ccgttttttttttttgatgcaga

SEQ ID NO: 19232 - DNA, 23 bp, Artificial Sequence
  Synthetic
ccgttttttttttttgatgcaga

SEQ ID NO: 19233 - DNA, 23 bp, Artificial Sequence
  Synthetic
ccgttttttttttttacgtgccc

SEQ ID NO: 19234 - DNA, 23 bp, Artificial Sequence
  Synthetic
ccgttttttttttttacgtgccc

SEQ ID NO: 19235 - DNA, 23 bp, Artificial Sequence
  Synthetic
ccgttttttttttttacgtaccc

SEQ ID NO: 19236 - DNA, 23 bp, Artificial Sequence
  Synthetic
ccgttttttttttttcacgtgcc

SEQ ID NO: 19237 - DNA, 23 bp, Artificial Sequence
  Synthetic
ccgttttttttttttacgtgccc

SEQ ID NO: 19238 - DNA, 23 bp, Artificial Sequence
  Synthetic
ccgttttttttttttacgtgccc

SEQ ID NO: 19239 - DNA, 23 bp, Artificial Sequence
  Synthetic
ccgttttttttttttggaatgaa

SEQ ID NO: 19240 - DNA, 23 bp, Artificial Sequence
  Synthetic
ccgttttttttttttggaatgaa

SEQ ID NO: 19241 - DNA, 23 bp, Artificial Sequence
  Synthetic
ccgttttttttttttggaatgaa

SEQ ID NO: 19242 - DNA, 23 bp, Artificial Sequence
  Synthetic
ccgttttttttttttggaatgaa

SEQ ID NO: 19243 - DNA, 23 bp, Artificial Sequence
  Synthetic
ccgttttttttttttggaatgaa

SEQ ID NO: 19244 - DNA, 23 bp, Artificial Sequence
  Synthetic
ccgttttttttttttggaatgaa

SEQ ID NO: 19245 - DNA, 23 bp, Artificial Sequence
  Synthetic
ccgttttttttttttggaatgaa

SEQ ID NO: 19246 - DNA, 23 bp, Artificial Sequence
  Synthetic
ccgttttttttttttggaatgaa

SEQ ID NO: 19247 - DNA, 23 bp, Artificial Sequence
  Synthetic
ccgttttttttttttggaatgaa

SEQ ID NO: 19248 - DNA, 23 bp, Artificial Sequence
  Synthetic
ccgttttttttttttggaatgaa

SEQ ID NO: 19249 - DNA, 23 bp, Artificial Sequence
  Synthetic
ccgttttttttttttggattgaa

SEQ ID NO: 19250 - DNA, 23 bp, Artificial Sequence
  Synthetic
ccgttttttttttttggattgaa

SEQ ID NO: 19251 - DNA, 23 bp, Artificial Sequence
  Synthetic
ccgttttttttttttggaatgaa

SEQ ID NO: 19252 - DNA, 23 bp, Artificial Sequence
  Synthetic
ccgttttttttttttggaatgaa

SEQ ID NO: 19253 - DNA, 23 bp, Artificial Sequence
  Synthetic
ccgttttttttttttatcatgct

SEQ ID NO: 19254 - DNA, 23 bp, Artificial Sequence
  Synthetic
ccgttttttttttttatcatgct

SEQ ID NO: 19255 - DNA, 23 bp, Artificial Sequence
  Synthetic
ccgttttttttttttatcatgct

SEQ ID NO: 19256 - DNA, 23 bp, Artificial Sequence
  Synthetic
ccgttttttttttttgatcatgc

SEQ ID NO: 19257 - DNA, 23 bp, Artificial Sequence
  Synthetic
ccgttttttttttttgatcatgc

SEQ ID NO: 19258 - DNA, 23 bp, Artificial Sequence
  Synthetic
ccgttttttttttttgatcatgc

SEQ ID NO: 19259 - DNA, 23 bp, Artificial Sequence
  Synthetic
ccgttttttttttttgatcatgc

SEQ ID NO: 19260 - DNA, 23 bp, Artificial Sequence
  Synthetic
ccgttttttttttttgatcatgc

SEQ ID NO: 19261 - DNA, 23 bp, Artificial Sequence
  Synthetic
ccgttttttttttttgatcatgc

SEQ ID NO: 19262 - DNA, 23 bp, Artificial Sequence
  Synthetic
ccgttttttttttttgatcatgc

SEQ ID NO: 19263 - DNA, 23 bp, Artificial Sequence
  Synthetic
ccgttttttttttttccgatctg

SEQ ID NO: 19264 - DNA, 23 bp, Artificial Sequence
  Synthetic
ccgttttttttttttcgagctgc

SEQ ID NO: 19265 - DNA, 23 bp, Artificial Sequence
  Synthetic
ccgttttttttttttgcaagtca

SEQ ID NO: 19266 - DNA, 23 bp, Artificial Sequence
  Synthetic
ccgttttttttttttggcaagtc

SEQ ID NO: 19267 - DNA, 23 bp, Artificial Sequence
  Synthetic
ccgttttttttttttggcaagtc

SEQ ID NO: 19268 - DNA, 23 bp, Artificial Sequence
  Synthetic
ccgttttttttttttggcaattc

SEQ ID NO: 19269 - DNA, 23 bp, Artificial Sequence
  Synthetic
ccgttttttttttttggcaagtc

SEQ ID NO: 19270 - DNA, 23 bp, Artificial Sequence
  Synthetic
ccgttttttttttttgcaagtca

SEQ ID NO: 19271 - DNA, 23 bp, Artificial Sequence
  Synthetic
ccgttttttttttttgcaagtca

SEQ ID NO: 19272 - DNA, 23 bp, Artificial Sequence
  Synthetic
ccgttttttttttttggcaagtc

SEQ ID NO: 19273 - DNA, 23 bp, Artificial Sequence
  Synthetic
ccgttttttttttttggcaagtc

SEQ ID NO: 19274 - DNA, 23 bp, Artificial Sequence
  Synthetic
ccgttttttttttttggcaagtc

SEQ ID NO: 19275 - DNA, 23 bp, Artificial Sequence
  Synthetic
ccgttttttttttttggcaagtc

SEQ ID NO: 19276 - DNA, 23 bp, Artificial Sequence
  Synthetic
ccgttttttttttttggcaagtc

SEQ ID NO: 19277 - DNA, 23 bp, Artificial Sequence
  Synthetic
ccgttttttttttttggcaagtc

SEQ ID NO: 19278 - DNA, 23 bp, Artificial Sequence
  Synthetic
ccgttttttttttttgcaagtca

SEQ ID NO: 19279 - DNA, 23 bp, Artificial Sequence
  Synthetic
ccgttttttttttttgcaagtca

SEQ ID NO: 19280 - DNA, 23 bp, Artificial Sequence
  Synthetic
ccgttttttttttttggcaagtt

SEQ ID NO: 19281 - DNA, 23 bp, Artificial Sequence
  Synthetic
ccgttttttttttttgggcagtc

SEQ ID NO: 19282 - DNA, 23 bp, Artificial Sequence
  Synthetic
ccgttttttttttttattggcgc

SEQ ID NO: 19283 - DNA, 23 bp, Artificial Sequence
  Synthetic
ccgttttttttttttattggcac

SEQ ID NO: 19284 - DNA, 23 bp, Artificial Sequence
  Synthetic
ccgttttttttttttattggcac

SEQ ID NO: 19285 - DNA, 23 bp, Artificial Sequence
  Synthetic
ccgttttttttttttattggcac

SEQ ID NO: 19286 - DNA, 23 bp, Artificial Sequence
  Synthetic
ccgttttttttttttattggcac

SEQ ID NO: 19287 - DNA, 23 bp, Artificial Sequence
  Synthetic
ccgttttttttttttattggcac

SEQ ID NO: 19288 - DNA, 23 bp, Artificial Sequence
  Synthetic
ccgttttttttttttattggctc

SEQ ID NO: 19289 - DNA, 23 bp, Artificial Sequence
  Synthetic
ccgttttttttttttgatattgg

SEQ ID NO: 19290 - DNA, 23 bp, Artificial Sequence
  Synthetic
ccgttttttttttttattgacgc

SEQ ID NO: 19291 - DNA, 23 bp, Artificial Sequence
  Synthetic
ccgttttttttttttcagcatca

SEQ ID NO: 19292 - DNA, 23 bp, Artificial Sequence
  Synthetic
ccgttttttttttttcagcatca

SEQ ID NO: 19293 - DNA, 23 bp, Artificial Sequence
  Synthetic
ccgttttttttttttcagcatca

SEQ ID NO: 19294 - DNA, 23 bp, Artificial Sequence
  Synthetic
ccgttttttttttttcagcatca

SEQ ID NO: 19295 - DNA, 23 bp, Artificial Sequence
  Synthetic
ccgttttttttttttgagcaccc

SEQ ID NO: 19296 - DNA, 23 bp, Artificial Sequence
  Synthetic
ccgttttttttttttgagcaccc

SEQ ID NO: 19297 - DNA, 23 bp, Artificial Sequence
  Synthetic
ccgttttttttttttcgctatcc

SEQ ID NO: 19298 - DNA, 23 bp, Artificial Sequence
  Synthetic
ccgttttttttttttcaatgcga

SEQ ID NO: 19299 - DNA, 23 bp, Artificial Sequence
  Synthetic
ccgttttttttttttatcaatgc

SEQ ID NO: 19300 - DNA, 23 bp, Artificial Sequence
  Synthetic
ccgttttttttttttaggtggac

SEQ ID NO: 19301 - DNA, 23 bp, Artificial Sequence
  Synthetic
ccgttttttttttttgttccccc

SEQ ID NO: 19302 - DNA, 23 bp, Artificial Sequence
  Synthetic
ccgttttttttttttgttccccc

SEQ ID NO: 19303 - DNA, 23 bp, Artificial Sequence
  Synthetic
ccgttttttttttttgttcctcc

SEQ ID NO: 19304 - DNA, 23 bp, Artificial Sequence
  Synthetic
ccgttttttttttttgttccccc

SEQ ID NO: 19305 - DNA, 23 bp, Artificial Sequence
  Synthetic
ccgttttttttttttgttccccc

SEQ ID NO: 19306 - DNA, 23 bp, Artificial Sequence
  Synthetic
ccgttttttttttttgttccccc

SEQ ID NO: 19307 - DNA, 23 bp, Artificial Sequence
  Synthetic
ccgttttttttttttgttccccc

SEQ ID NO: 19308 - DNA, 23 bp, Artificial Sequence
  Synthetic
ccgttttttttttttgttccccc

SEQ ID NO: 19309 - DNA, 23 bp, Artificial Sequence
  Synthetic
ccgttttttttttttgttccccc

SEQ ID NO: 19310 - DNA, 23 bp, Artificial Sequence
  Synthetic
ccgttttttttttttgttccccc

SEQ ID NO: 19311 - DNA, 23 bp, Artificial Sequence
  Synthetic
ccgttttttttttttgttccccc

SEQ ID NO: 19312 - DNA, 23 bp, Artificial Sequence
  Synthetic
ccgttttttttttttgttccccc

SEQ ID NO: 19313 - DNA, 23 bp, Artificial Sequence
  Synthetic
ccgttttttttttttgttccccc

SEQ ID NO: 19314 - DNA, 23 bp, Artificial Sequence
  Synthetic
ccgttttttttttttgttccccc

SEQ ID NO: 19315 - DNA, 23 bp, Artificial Sequence
  Synthetic
ccgttttttttttttgttcctcc

SEQ ID NO: 19316 - DNA, 23 bp, Artificial Sequence
  Synthetic
ccgttttttttttttgttccccc

SEQ ID NO: 19317 - DNA, 23 bp, Artificial Sequence
  Synthetic
ccgttttttttttttgttccccc

SEQ ID NO: 19318 - DNA, 23 bp, Artificial Sequence
  Synthetic
ccgttttttttttttgttccccc

SEQ ID NO: 19319 - DNA, 23 bp, Artificial Sequence
  Synthetic
ccgttttttttttttgttccccc

SEQ ID NO: 19320 - DNA, 23 bp, Artificial Sequence
  Synthetic
ccgttttttttttttgtttcccc

SEQ ID NO: 19321 - DNA, 23 bp, Artificial Sequence
  Synthetic
ccgttttttttttttcccccaaa

SEQ ID NO: 19322 - DNA, 23 bp, Artificial Sequence
  Synthetic
ccgttttttttttttgttccgcc

SEQ ID NO: 19323 - DNA, 23 bp, Artificial Sequence
  Synthetic
ccgttttttttttttgaatcccc

SEQ ID NO: 19324 - DNA, 23 bp, Artificial Sequence
  Synthetic
ccgttttttttttttgttcaaga

SEQ ID NO: 19325 - DNA, 23 bp, Artificial Sequence
  Synthetic
ccgttttttttttttgttcaaga

SEQ ID NO: 19326 - DNA, 23 bp, Artificial Sequence
  Synthetic
ccgttttttttttttgttcaaga

SEQ ID NO: 19327 - DNA, 23 bp, Artificial Sequence
  Synthetic
ccgttttttttttttgttcaaga

SEQ ID NO: 19328 - DNA, 23 bp, Artificial Sequence
  Synthetic
ccgttttttttttttgttcaaga

SEQ ID NO: 19329 - DNA, 23 bp, Artificial Sequence
  Synthetic
ccgttttttttttttcaacgctg

SEQ ID NO: 19330 - DNA, 23 bp, Artificial Sequence
  Synthetic
ccgttttttttttttcaacgctg

SEQ ID NO: 19331 - DNA, 23 bp, Artificial Sequence
  Synthetic
ccgttttttttttttggggtgac

SEQ ID NO: 19332 - DNA, 23 bp, Artificial Sequence
  Synthetic
ccgttttttttttttggggcgac

SEQ ID NO: 19333 - DNA, 23 bp, Artificial Sequence
  Synthetic
ccgttttttttttttgggcaatt

SEQ ID NO: 19334 - DNA, 23 bp, Artificial Sequence
  Synthetic
ccgttttttttttttgggcaatt

SEQ ID NO: 19335 - DNA, 23 bp, Artificial Sequence
  Synthetic
ccgttttttttttttgggcaatt

SEQ ID NO: 19336 - DNA, 23 bp, Artificial Sequence
  Synthetic
ccgttttttttttttgggcaact

SEQ ID NO: 19337 - DNA, 23 bp, Artificial Sequence
  Synthetic
ccgttttttttttttggcaaatc

SEQ ID NO: 19338 - DNA, 23 bp, Artificial Sequence
  Synthetic
ccgttttttttttttggcaaatc

SEQ ID NO: 19339 - DNA, 23 bp, Artificial Sequence
  Synthetic
ccgttttttttttttggcaaatc

SEQ ID NO: 19340 - DNA, 23 bp, Artificial Sequence
  Synthetic
ccgttttttttttttggcaagtc

SEQ ID NO: 19341 - DNA, 23 bp, Artificial Sequence
  Synthetic
ccgttttttttttttgggcagct

SEQ ID NO: 19342 - DNA, 23 bp, Artificial Sequence
  Synthetic
ccgttttttttttttggcaactc

SEQ ID NO: 19343 - DNA, 23 bp, Artificial Sequence
  Synthetic
ccgttttttttttttgggcaaat

SEQ ID NO: 19344 - DNA, 23 bp, Artificial Sequence
  Synthetic
ccgttttttttttttcagggaag

SEQ ID NO: 19345 - DNA, 23 bp, Artificial Sequence
  Synthetic
ccgttttttttttttcagaacaa

SEQ ID NO: 19346 - DNA, 23 bp, Artificial Sequence
  Synthetic
ccgttttttttttttacgatgat

SEQ ID NO: 19347 - DNA, 23 bp, Artificial Sequence
  Synthetic
ccgttttttttttttctctgctt

SEQ ID NO: 19348 - DNA, 23 bp, Artificial Sequence
  Synthetic
ccgttttttttttttacagtgta

SEQ ID NO: 19349 - DNA, 23 bp, Artificial Sequence
  Synthetic
ccgttttttttttttaacaaatt

SEQ ID NO: 19350 - DNA, 23 bp, Artificial Sequence
  Synthetic
ccgttttttttttttcatttcat

SEQ ID NO: 19351 - DNA, 23 bp, Artificial Sequence
  Synthetic
ccgttttttttttttacatcgtc

SEQ ID NO: 19352 - DNA, 23 bp, Artificial Sequence
  Synthetic
ccgttttttttttttatttccgt

SEQ ID NO: 19353 - DNA, 23 bp, Artificial Sequence
  Synthetic
ccgttttttttttttaaggacaa

SEQ ID NO: 19354 - DNA, 23 bp, Artificial Sequence
  Synthetic
ccgttttttttttttactccaat

SEQ ID NO: 19355 - DNA, 23 bp, Artificial Sequence
  Synthetic
ccgttttttttttttgtcaaact

SEQ ID NO: 19356 - DNA, 23 bp, Artificial Sequence
  Synthetic
ccgttttttttttttctataacg

SEQ ID NO: 19357 - DNA, 23 bp, Artificial Sequence
  Synthetic
ccgttttttttttttaacaaccg

SEQ ID NO: 19358 - DNA, 23 bp, Artificial Sequence
  Synthetic
ccgttttttttttttaacaaccg

SEQ ID NO: 19359 - DNA, 23 bp, Artificial Sequence
  Synthetic
ccgttttttttttttaacaaccg

SEQ ID NO: 19360 - DNA, 23 bp, Artificial Sequence
  Synthetic
ccgttttttttttttaacaaccg

SEQ ID NO: 19361 - DNA, 23 bp, Artificial Sequence
  Synthetic
ccgttttttttttttaacaaccg

SEQ ID NO: 19362 - DNA, 23 bp, Artificial Sequence
  Synthetic
ccgttttttttttttaacaaccg

SEQ ID NO: 19363 - DNA, 23 bp, Artificial Sequence
  Synthetic
ccgttttttttttttaacaaccg

SEQ ID NO: 19364 - DNA, 23 bp, Artificial Sequence
  Synthetic
ccgttttttttttttaacaaccg

SEQ ID NO: 19365 - DNA, 23 bp, Artificial Sequence
  Synthetic
ccgttttttttttttaacaaccg

SEQ ID NO: 19366 - DNA, 23 bp, Artificial Sequence
  Synthetic
ccgttttttttttttaacaaccg

SEQ ID NO: 19367 - DNA, 23 bp, Artificial Sequence
  Synthetic
ccgttttttttttttccgatcat

SEQ ID NO: 19368 - DNA, 23 bp, Artificial Sequence
  Synthetic
ccgttttttttttttcacattta

SEQ ID NO: 19369 - DNA, 23 bp, Artificial Sequence
  Synthetic
ccgttttttttttttcacattta

SEQ ID NO: 19370 - DNA, 23 bp, Artificial Sequence
  Synthetic
ccgttttttttttttcacattta

SEQ ID NO: 19371 - DNA, 23 bp, Artificial Sequence
  Synthetic
ccgttttttttttttgtctcgca

SEQ ID NO: 19372 - DNA, 23 bp, Artificial Sequence
  Synthetic
ccgttttttttttttagatttat

SEQ ID NO: 19373 - DNA, 23 bp, Artificial Sequence
  Synthetic
ccgttttttttttttagcaagct

SEQ ID NO: 19374 - DNA, 23 bp, Artificial Sequence
  Synthetic
ccgttttttttttttggatgttt

SEQ ID NO: 19375 - DNA, 23 bp, Artificial Sequence
  Synthetic
ccgttttttttttttggatgttt

SEQ ID NO: 19376 - DNA, 23 bp, Artificial Sequence
  Synthetic
ccgttttttttttttggatgttt

SEQ ID NO: 19377 - DNA, 23 bp, Artificial Sequence
  Synthetic
ccgttttttttttttggatgttt

SEQ ID NO: 19378 - DNA, 23 bp, Artificial Sequence
  Synthetic
ccgttttttttttttggatgttt

SEQ ID NO: 19379 - DNA, 23 bp, Artificial Sequence
  Synthetic
ccgttttttttttttggatgttt

SEQ ID NO: 19380 - DNA, 23 bp, Artificial Sequence
  Synthetic
ccgttttttttttttggatgttt

SEQ ID NO: 19381 - DNA, 23 bp, Artificial Sequence
  Synthetic
ccgttttttttttttggatgttt

SEQ ID NO: 19382 - DNA, 23 bp, Artificial Sequence
  Synthetic
ccgttttttttttttggatgttt

SEQ ID NO: 19383 - DNA, 23 bp, Artificial Sequence
  Synthetic
ccgttttttttttttatttccca

SEQ ID NO: 19384 - DNA, 23 bp, Artificial Sequence
  Synthetic
ccgttttttttttttctctgcat

SEQ ID NO: 19385 - DNA, 23 bp, Artificial Sequence
  Synthetic
ccgttttttttttttagaagaga

SEQ ID NO: 19386 - DNA, 23 bp, Artificial Sequence
  Synthetic
ccgttttttttttttcatctgcc

SEQ ID NO: 19387 - DNA, 23 bp, Artificial Sequence
  Synthetic
ccgttttttttttttgcggcacg

SEQ ID NO: 19388 - DNA, 23 bp, Artificial Sequence
  Synthetic
ccgttttttttttttgtgctctc

SEQ ID NO: 19389 - DNA, 23 bp, Artificial Sequence
  Synthetic
ccgttttttttttttccgttgac

SEQ ID NO: 19390 - DNA, 23 bp, Artificial Sequence
  Synthetic
ccgttttttttttttccgttgac

SEQ ID NO: 19391 - DNA, 23 bp, Artificial Sequence
  Synthetic
ccgttttttttttttccgttgac

SEQ ID NO: 19392 - DNA, 23 bp, Artificial Sequence
  Synthetic
ccgttttttttttttccgttgac

SEQ ID NO: 19393 - DNA, 23 bp, Artificial Sequence
  Synthetic
ccgttttttttttttccgttgac

SEQ ID NO: 19394 - DNA, 23 bp, Artificial Sequence
  Synthetic
ccgttttttttttttccgttgac

SEQ ID NO: 19395 - DNA, 23 bp, Artificial Sequence
  Synthetic
ccgttttttttttttccgttgac

SEQ ID NO: 19396 - DNA, 23 bp, Artificial Sequence
  Synthetic
ccgttttttttttttccgttgac

SEQ ID NO: 19397 - DNA, 23 bp, Artificial Sequence
  Synthetic
ccgttttttttttttattcacct

SEQ ID NO: 19398 - DNA, 23 bp, Artificial Sequence
  Synthetic
ccgttttttttttttattcacct

SEQ ID NO: 19399 - DNA, 23 bp, Artificial Sequence
  Synthetic
ccgttttttttttttattcacct

SEQ ID NO: 19400 - DNA, 23 bp, Artificial Sequence
  Synthetic
ccgttttttttttttcatttccc

SEQ ID NO: 19401 - DNA, 23 bp, Artificial Sequence
  Synthetic
ccgttttttttttttaacatttc

SEQ ID NO: 19402 - DNA, 23 bp, Artificial Sequence
  Synthetic
ccgttttttttttttaacatttc

SEQ ID NO: 19403 - DNA, 23 bp, Artificial Sequence
  Synthetic
ccgttttttttttttaacatttc

SEQ ID NO: 19404 - DNA, 23 bp, Artificial Sequence
  Synthetic
ccgttttttttttttaacatttc

SEQ ID NO: 19405 - DNA, 23 bp, Artificial Sequence
  Synthetic
ccgttttttttttttaacatttc

SEQ ID NO: 19406 - DNA, 23 bp, Artificial Sequence
  Synthetic
ccgttttttttttttaacatttc

SEQ ID NO: 19407 - DNA, 23 bp, Artificial Sequence
  Synthetic
ccgttttttttttttaacatttc

SEQ ID NO: 19408 - DNA, 23 bp, Artificial Sequence
  Synthetic
ccgttttttttttttaacatttc

SEQ ID NO: 19409 - DNA, 23 bp, Artificial Sequence
  Synthetic
ccgttttttttttttacatgtgg

SEQ ID NO: 19410 - DNA, 23 bp, Artificial Sequence
  Synthetic
ccgttttttttttttgtccattt

SEQ ID NO: 19411 - DNA, 23 bp, Artificial Sequence
  Synthetic
ccgttttttttttttgtccattt

SEQ ID NO: 19412 - DNA, 23 bp, Artificial Sequence
  Synthetic
ccgttttttttttttgtccattt

SEQ ID NO: 19413 - DNA, 23 bp, Artificial Sequence
  Synthetic
ccgttttttttttttcaacgttt

SEQ ID NO: 19414 - DNA, 23 bp, Artificial Sequence
  Synthetic
ccgttttttttttttcaacgttt

SEQ ID NO: 19415 - DNA, 23 bp, Artificial Sequence
  Synthetic
ccgttttttttttttcaacgttt

SEQ ID NO: 19416 - DNA, 23 bp, Artificial Sequence
  Synthetic
ccgttttttttttttcaacgttt

SEQ ID NO: 19417 - DNA, 23 bp, Artificial Sequence
  Synthetic
ccgttttttttttttcaacgttt

SEQ ID NO: 19418 - DNA, 23 bp, Artificial Sequence
  Synthetic
ccgttttttttttttaaaaccca

SEQ ID NO: 19419 - DNA, 23 bp, Artificial Sequence
  Synthetic
ccgttttttttttttattcgttg

SEQ ID NO: 19420 - DNA, 23 bp, Artificial Sequence
  Synthetic
ccgttttttttttttattcgttg

SEQ ID NO: 19421 - DNA, 23 bp, Artificial Sequence
  Synthetic
ccgttttttttttttattcgttg

SEQ ID NO: 19422 - DNA, 23 bp, Artificial Sequence
  Synthetic
ccgttttttttttttcaatctcc

SEQ ID NO: 19423 - DNA, 23 bp, Artificial Sequence
  Synthetic
ccgttttttttttttcaatctcc

SEQ ID NO: 19424 - DNA, 23 bp, Artificial Sequence
  Synthetic
ccgttttttttttttcaatctcc

SEQ ID NO: 19425 - DNA, 23 bp, Artificial Sequence
  Synthetic
ccgttttttttttttagtaaaat

SEQ ID NO: 19426 - DNA, 23 bp, Artificial Sequence
  Synthetic
ccgttttttttttttatcgggcc

SEQ ID NO: 19427 - DNA, 23 bp, Artificial Sequence
  Synthetic
ccgttttttttttttgtcccata

SEQ ID NO: 19428 - DNA, 23 bp, Artificial Sequence
  Synthetic
ccgttttttttttttgtcccata

SEQ ID NO: 19429 - DNA, 23 bp, Artificial Sequence
  Synthetic
ccgttttttttttttgtcccata

SEQ ID NO: 19430 - DNA, 23 bp, Artificial Sequence
  Synthetic
ccgttttttttttttgtcccata

SEQ ID NO: 19431 - DNA, 23 bp, Artificial Sequence
  Synthetic
ccgttttttttttttgtcccata

SEQ ID NO: 19432 - DNA, 23 bp, Artificial Sequence
  Synthetic
ccgttttttttttttagaaagtc

SEQ ID NO: 19433 - DNA, 23 bp, Artificial Sequence
  Synthetic
ccgttttttttttttagaaagtc

SEQ ID NO: 19434 - DNA, 23 bp, Artificial Sequence
  Synthetic
ccgttttttttttttagaaagtc

SEQ ID NO: 19435 - DNA, 23 bp, Artificial Sequence
  Synthetic
ccgttttttttttttagaaagtc

SEQ ID NO: 19436 - DNA, 23 bp, Artificial Sequence
  Synthetic
ccgttttttttttttagaaagtc

SEQ ID NO: 19437 - DNA, 23 bp, Artificial Sequence
  Synthetic
ccgttttttttttttagaaagtc

SEQ ID NO: 19438 - DNA, 23 bp, Artificial Sequence
  Synthetic
ccgttttttttttttagaaagtc

SEQ ID NO: 19439 - DNA, 23 bp, Artificial Sequence
  Synthetic
ccgttttttttttttagaaagtc

SEQ ID NO: 19440 - DNA, 23 bp, Artificial Sequence
  Synthetic
ccgttttttttttttagaaagtc

SEQ ID NO: 19441 - DNA, 23 bp, Artificial Sequence
  Synthetic
ccgttttttttttttagaaagtc

SEQ ID NO: 19442 - DNA, 23 bp, Artificial Sequence
  Synthetic
ccgttttttttttttagaaagtc

SEQ ID NO: 19443 - DNA, 23 bp, Artificial Sequence
  Synthetic
ccgttttttttttttggtccatc

SEQ ID NO: 19444 - DNA, 23 bp, Artificial Sequence
  Synthetic
ccgttttttttttttggtccatc

SEQ ID NO: 19445 - DNA, 23 bp, Artificial Sequence
  Synthetic
ccgttttttttttttggtccatc

SEQ ID NO: 19446 - DNA, 23 bp, Artificial Sequence
  Synthetic
ccgttttttttttttaacttttt

SEQ ID NO: 19447 - DNA, 23 bp, Artificial Sequence
  Synthetic
ccgttttttttttttaacttttt

SEQ ID NO: 19448 - DNA, 23 bp, Artificial Sequence
  Synthetic
ccgttttttttttttaacttttt

SEQ ID NO: 19449 - DNA, 23 bp, Artificial Sequence
  Synthetic
ccgttttttttttttatacttct

SEQ ID NO: 19450 - DNA, 23 bp, Artificial Sequence
  Synthetic
ccgttttttttttttcaagttcg

SEQ ID NO: 19451 - DNA, 23 bp, Artificial Sequence
  Synthetic
ccgttttttttttttagttatca

SEQ ID NO: 19452 - DNA, 23 bp, Artificial Sequence
  Synthetic
ccgttttttttttttagccctgt

SEQ ID NO: 19453 - DNA, 23 bp, Artificial Sequence
  Synthetic
ccgttttttttttttaggagtct

SEQ ID NO: 19454 - DNA, 23 bp, Artificial Sequence
  Synthetic
ccgttttttttttttacctgcac

SEQ ID NO: 19455 - DNA, 23 bp, Artificial Sequence
  Synthetic
ccgttttttttttttgcactgtc

SEQ ID NO: 19456 - DNA, 23 bp, Artificial Sequence
  Synthetic
ccgttttttttttttagccctgt

SEQ ID NO: 19457 - DNA, 23 bp, Artificial Sequence
  Synthetic
ccgttttttttttttcaaattcg

SEQ ID NO: 19458 - DNA, 23 bp, Artificial Sequence
  Synthetic
ccgttttttttttttaaattcgg

SEQ ID NO: 19459 - DNA, 23 bp, Artificial Sequence
  Synthetic
ccgttttttttttttcattcacc

SEQ ID NO: 19460 - DNA, 23 bp, Artificial Sequence
  Synthetic
ccgttttttttttttcaagttag

SEQ ID NO: 19461 - DNA, 23 bp, Artificial Sequence
  Synthetic
ccgttttttttttttaagagacc

SEQ ID NO: 19462 - DNA, 23 bp, Artificial Sequence
  Synthetic
ccgttttttttttttccttttaa

SEQ ID NO: 19463 - DNA, 23 bp, Artificial Sequence
  Synthetic
ccgttttttttttttagctggtt

SEQ ID NO: 19464 - DNA, 23 bp, Artificial Sequence
  Synthetic
ccgttttttttttttctctggtc

SEQ ID NO: 19465 - DNA, 23 bp, Artificial Sequence
  Synthetic
ccgttttttttttttcataggaa

SEQ ID NO: 19466 - DNA, 23 bp, Artificial Sequence
  Synthetic
ccgttttttttttttatcatcaa

SEQ ID NO: 19467 - DNA, 23 bp, Artificial Sequence
  Synthetic
ccgttttttttttttacacgtgc

SEQ ID NO: 19468 - DNA, 23 bp, Artificial Sequence
  Synthetic
ccgttttttttttttatctttac

SEQ ID NO: 19469 - DNA, 23 bp, Artificial Sequence
  Synthetic
ccgttttttttttttgctacagt

SEQ ID NO: 19470 - DNA, 23 bp, Artificial Sequence
  Synthetic
ccgttttttttttttgtacatca

SEQ ID NO: 19471 - DNA, 23 bp, Artificial Sequence
  Synthetic
ccgttttttttttttagaagcat

SEQ ID NO: 19472 - DNA, 23 bp, Artificial Sequence
  Synthetic
ccgttttttttttttaaggcaac

SEQ ID NO: 19473 - DNA, 23 bp, Artificial Sequence
  Synthetic
ccgttttttttttttcaaaccat

SEQ ID NO: 19474 - DNA, 23 bp, Artificial Sequence
  Synthetic
ccgttttttttttttaaccatga

SEQ ID NO: 19475 - DNA, 23 bp, Artificial Sequence
  Synthetic
ccgttttttttttttccaatatt

SEQ ID NO: 19476 - DNA, 23 bp, Artificial Sequence
  Synthetic
ccgttttttttttttaagtgcct

SEQ ID NO: 19477 - DNA, 23 bp, Artificial Sequence
  Synthetic
ccgttttttttttttacctgcac

SEQ ID NO: 19478 - DNA, 23 bp, Artificial Sequence
  Synthetic
ccgttttttttttttgcactaga

SEQ ID NO: 19479 - DNA, 23 bp, Artificial Sequence
  Synthetic
ccgttttttttttttcaccgaca

SEQ ID NO: 19480 - DNA, 23 bp, Artificial Sequence
  Synthetic
ccgttttttttttttacaatcaa

SEQ ID NO: 19481 - DNA, 23 bp, Artificial Sequence
  Synthetic
ccgttttttttttttcccaccga

SEQ ID NO: 19482 - DNA, 23 bp, Artificial Sequence
  Synthetic
ccgttttttttttttcaccgaca

SEQ ID NO: 19483 - DNA, 23 bp, Artificial Sequence
  Synthetic
ccgttttttttttttgtgaattc

SEQ ID NO: 19484 - DNA, 23 bp, Artificial Sequence
  Synthetic
ccgttttttttttttgcccaaaa

SEQ ID NO: 19485 - DNA, 23 bp, Artificial Sequence
  Synthetic
ccgttttttttttttgctgcaac

SEQ ID NO: 19486 - DNA, 23 bp, Artificial Sequence
  Synthetic
ccgttttttttttttcctccacc

SEQ ID NO: 19487 - DNA, 23 bp, Artificial Sequence
  Synthetic
ccgttttttttttttgatatcag

SEQ ID NO: 19488 - DNA, 23 bp, Artificial Sequence
  Synthetic
ccgttttttttttttctaatata

SEQ ID NO: 19489 - DNA, 23 bp, Artificial Sequence
  Synthetic
ccgttttttttttttcaatattt

SEQ ID NO: 19490 - DNA, 23 bp, Artificial Sequence
  Synthetic
ccgttttttttttttcaacaaca

SEQ ID NO: 19491 - DNA, 23 bp, Artificial Sequence
  Synthetic
ccgttttttttttttgggtggag

SEQ ID NO: 19492 - DNA, 23 bp, Artificial Sequence
  Synthetic
ccgttttttttttttatctcccc

SEQ ID NO: 19493 - DNA, 23 bp, Artificial Sequence
  Synthetic
ccgttttttttttttacaggtag

SEQ ID NO: 19494 - DNA, 23 bp, Artificial Sequence
  Synthetic
ccgttttttttttttgttttgca

SEQ ID NO: 19495 - DNA, 23 bp, Artificial Sequence
  Synthetic
ccgttttttttttttgttttgca

SEQ ID NO: 19496 - DNA, 23 bp, Artificial Sequence
  Synthetic
ccgttttttttttttctgcacta

SEQ ID NO: 19497 - DNA, 23 bp, Artificial Sequence
  Synthetic
ccgttttttttttttgcatagga

SEQ ID NO: 19498 - DNA, 23 bp, Artificial Sequence
  Synthetic
ccgttttttttttttgactccgg

SEQ ID NO: 19499 - DNA, 23 bp, Artificial Sequence
  Synthetic
ccgttttttttttttacatcagt

SEQ ID NO: 19500 - DNA, 23 bp, Artificial Sequence
  Synthetic
ccgttttttttttttcctgtctg

SEQ ID NO: 19501 - DNA, 23 bp, Artificial Sequence
  Synthetic
ccgttttttttttttcagttgcc

SEQ ID NO: 19502 - DNA, 23 bp, Artificial Sequence
  Synthetic
ccgttttttttttttcaatcagt

SEQ ID NO: 19503 - DNA, 23 bp, Artificial Sequence
  Synthetic
ccgttttttttttttatggttag

SEQ ID NO: 19504 - DNA, 23 bp, Artificial Sequence
  Synthetic
ccgttttttttttttagttcttc

SEQ ID NO: 19505 - DNA, 23 bp, Artificial Sequence
  Synthetic
ccgttttttttttttagtgtcag

SEQ ID NO: 19506 - DNA, 23 bp, Artificial Sequence
  Synthetic
ccgttttttttttttaacccagc

SEQ ID NO: 19507 - DNA, 23 bp, Artificial Sequence
  Synthetic
ccgttttttttttttggtatttg

SEQ ID NO: 19508 - DNA, 23 bp, Artificial Sequence
  Synthetic
ccgttttttttttttacggaacc

SEQ ID NO: 19509 - DNA, 23 bp, Artificial Sequence
  Synthetic
ccgttttttttttttaaatccct

SEQ ID NO: 19510 - DNA, 23 bp, Artificial Sequence
  Synthetic
ccgttttttttttttgtaatccc

SEQ ID NO: 19511 - DNA, 23 bp, Artificial Sequence
  Synthetic
ccgttttttttttttcctgctga

SEQ ID NO: 19512 - DNA, 23 bp, Artificial Sequence
  Synthetic
ccgttttttttttttgaccgaga

SEQ ID NO: 19513 - DNA, 23 bp, Artificial Sequence
  Synthetic
ccgttttttttttttcctatcct

SEQ ID NO: 19514 - DNA, 23 bp, Artificial Sequence
  Synthetic
ccgttttttttttttcggaactt

SEQ ID NO: 19515 - DNA, 23 bp, Artificial Sequence
  Synthetic
ccgttttttttttttaatagact

SEQ ID NO: 19516 - DNA, 23 bp, Artificial Sequence
  Synthetic
ccgttttttttttttccgatttc

SEQ ID NO: 19517 - DNA, 23 bp, Artificial Sequence
  Synthetic
ccgttttttttttttgatttcaa

SEQ ID NO: 19518 - DNA, 23 bp, Artificial Sequence
  Synthetic
ccgttttttttttttgcaaacat

SEQ ID NO: 19519 - DNA, 23 bp, Artificial Sequence
  Synthetic
ccgttttttttttttcagtcgag

SEQ ID NO: 19520 - DNA, 23 bp, Artificial Sequence
  Synthetic
ccgttttttttttttgagtgtag

SEQ ID NO: 19521 - DNA, 23 bp, Artificial Sequence
  Synthetic
ccgttttttttttttcagtcggg

SEQ ID NO: 19522 - DNA, 23 bp, Artificial Sequence
  Synthetic
ccgttttttttttttgctatgcc

SEQ ID NO: 19523 - DNA, 23 bp, Artificial Sequence
  Synthetic
ccgttttttttttttaacttagt

SEQ ID NO: 19524 - DNA, 23 bp, Artificial Sequence
  Synthetic
ccgttttttttttttatgcaact

SEQ ID NO: 19525 - DNA, 23 bp, Artificial Sequence
  Synthetic
ccgttttttttttttaaccagct

SEQ ID NO: 19526 - DNA, 23 bp, Artificial Sequence
  Synthetic
ccgttttttttttttcaaaatca

SEQ ID NO: 19527 - DNA, 23 bp, Artificial Sequence
  Synthetic
ccgttttttttttttaggccggg

SEQ ID NO: 19528 - DNA, 23 bp, Artificial Sequence
  Synthetic
ccgttttttttttttcctgcacg

SEQ ID NO: 19529 - DNA, 23 bp, Artificial Sequence
  Synthetic
ccgttttttttttttcaataaat

SEQ ID NO: 19530 - DNA, 23 bp, Artificial Sequence
  Synthetic
ccgttttttttttttaaaaatgt

SEQ ID NO: 19531 - DNA, 23 bp, Artificial Sequence
  Synthetic
ccgttttttttttttcaatacaa

SEQ ID NO: 19532 - DNA, 23 bp, Artificial Sequence
  Synthetic
ccgttttttttttttcaagatcg

SEQ ID NO: 19533 - DNA, 23 bp, Artificial Sequence
  Synthetic
ccgttttttttttttctcccaca

SEQ ID NO: 19534 - DNA, 23 bp, Artificial Sequence
  Synthetic
ccgttttttttttttcataacca

SEQ ID NO: 19535 - DNA, 23 bp, Artificial Sequence
  Synthetic
ccgttttttttttttcattctat

SEQ ID NO: 19536 - DNA, 23 bp, Artificial Sequence
  Synthetic
ccgttttttttttttccacgaag

SEQ ID NO: 19537 - DNA, 23 bp, Artificial Sequence
  Synthetic
ccgttttttttttttccgcgaga

SEQ ID NO: 19538 - DNA, 23 bp, Artificial Sequence
  Synthetic
ccgttttttttttttatacagtt

SEQ ID NO: 19539 - DNA, 23 bp, Artificial Sequence
  Synthetic
ccgttttttttttttacaagcgc

SEQ ID NO: 19540 - DNA, 23 bp, Artificial Sequence
  Synthetic
ccgttttttttttttacatcatg

SEQ ID NO: 19541 - DNA, 23 bp, Artificial Sequence
  Synthetic
ccgttttttttttttgaggccta

SEQ ID NO: 19542 - DNA, 23 bp, Artificial Sequence
  Synthetic
ccgttttttttttttgctagtga

SEQ ID NO: 19543 - DNA, 23 bp, Artificial Sequence
  Synthetic
ccgttttttttttttgctagtga

SEQ ID NO: 19544 - DNA, 23 bp, Artificial Sequence
  Synthetic
ccgttttttttttttgctagtga

SEQ ID NO: 19545 - DNA, 23 bp, Artificial Sequence
  Synthetic
ccgttttttttttttgctagtga

SEQ ID NO: 19546 - DNA, 23 bp, Artificial Sequence
  Synthetic
ccgttttttttttttaactcctc

SEQ ID NO: 19547 - DNA, 23 bp, Artificial Sequence
  Synthetic
ccgttttttttttttaactcctc

SEQ ID NO: 19548 - DNA, 23 bp, Artificial Sequence
  Synthetic
ccgttttttttttttccctgcac

SEQ ID NO: 19549 - DNA, 23 bp, Artificial Sequence
  Synthetic
ccgttttttttttttccaatgaa

SEQ ID NO: 19550 - DNA, 23 bp, Artificial Sequence
  Synthetic
ccgttttttttttttaggtgtat

SEQ ID NO: 19551 - DNA, 23 bp, Artificial Sequence
  Synthetic
ccgttttttttttttctcactct

SEQ ID NO: 19552 - DNA, 23 bp, Artificial Sequence
  Synthetic
ccgttttttttttttagctccct

SEQ ID NO: 19553 - DNA, 23 bp, Artificial Sequence
  Synthetic
ccgttttttttttttagctccct

SEQ ID NO: 19554 - DNA, 23 bp, Artificial Sequence
  Synthetic
ccgttttttttttttgagctccc

SEQ ID NO: 19555 - DNA, 23 bp, Artificial Sequence
  Synthetic
ccgttttttttttttgagctccc

SEQ ID NO: 19556 - DNA, 23 bp, Artificial Sequence
  Synthetic
ccgttttttttttttcgctatcc

SEQ ID NO: 19557 - DNA, 23 bp, Artificial Sequence
  Synthetic
ccgttttttttttttcgctatcc

SEQ ID NO: 19558 - DNA, 23 bp, Artificial Sequence
  Synthetic
ccgttttttttttttcgctatcc

SEQ ID NO: 19559 - DNA, 23 bp, Artificial Sequence
  Synthetic
ccgttttttttttttctcacagc

SEQ ID NO: 19560 - DNA, 23 bp, Artificial Sequence
  Synthetic
ccgttttttttttttctcacagc

SEQ ID NO: 19561 - DNA, 23 bp, Artificial Sequence
  Synthetic
ccgttttttttttttgcaactgc

SEQ ID NO: 19562 - DNA, 23 bp, Artificial Sequence
  Synthetic
ccgttttttttttttgtgctctc

SEQ ID NO: 19563 - DNA, 23 bp, Artificial Sequence
  Synthetic
ccgttttttttttttgtgctctc

SEQ ID NO: 19564 - DNA, 23 bp, Artificial Sequence
  Synthetic
ccgttttttttttttgtgctctc

SEQ ID NO: 19565 - DNA, 23 bp, Artificial Sequence
  Synthetic
ccgttttttttttttcgtgctct

SEQ ID NO: 19566 - DNA, 23 bp, Artificial Sequence
  Synthetic
ccgttttttttttttcacacagc

SEQ ID NO: 19567 - DNA, 23 bp, Artificial Sequence
  Synthetic
ccgttttttttttttcctgtaga

SEQ ID NO: 19568 - DNA, 23 bp, Artificial Sequence
  Synthetic
ccgttttttttttttcctgtaga

SEQ ID NO: 19569 - DNA, 23 bp, Artificial Sequence
  Synthetic
ccgttttttttttttagacatag

SEQ ID NO: 19570 - DNA, 23 bp, Artificial Sequence
  Synthetic
ccgttttttttttttagacatag

SEQ ID NO: 19571 - DNA, 23 bp, Artificial Sequence
  Synthetic
ccgttttttttttttagacatag

SEQ ID NO: 19572 - DNA, 23 bp, Artificial Sequence
  Synthetic
ccgttttttttttttcaagttcg

SEQ ID NO: 19573 - DNA, 23 bp, Artificial Sequence
  Synthetic
ccgttttttttttttagttatca

SEQ ID NO: 19574 - DNA, 23 bp, Artificial Sequence
  Synthetic
ccgttttttttttttagccctgt

SEQ ID NO: 19575 - DNA, 23 bp, Artificial Sequence
  Synthetic
ccgttttttttttttaggagtct

SEQ ID NO: 19576 - DNA, 23 bp, Artificial Sequence
  Synthetic
ccgttttttttttttacctgcac

SEQ ID NO: 19577 - DNA, 23 bp, Artificial Sequence
  Synthetic
ccgttttttttttttgcactgtc

SEQ ID NO: 19578 - DNA, 23 bp, Artificial Sequence
  Synthetic
ccgttttttttttttagccctgt

SEQ ID NO: 19579 - DNA, 23 bp, Artificial Sequence
  Synthetic
ccgttttttttttttcaaattcg

SEQ ID NO: 19580 - DNA, 23 bp, Artificial Sequence
  Synthetic
ccgttttttttttttcattcacc

SEQ ID NO: 19581 - DNA, 23 bp, Artificial Sequence
  Synthetic
ccgttttttttttttcaagttag

SEQ ID NO: 19582 - DNA, 23 bp, Artificial Sequence
  Synthetic
ccgttttttttttttccaagctc

SEQ ID NO: 19583 - DNA, 23 bp, Artificial Sequence
  Synthetic
ccgttttttttttttaagagacc

SEQ ID NO: 19584 - DNA, 23 bp, Artificial Sequence
  Synthetic
ccgttttttttttttagctggtt

SEQ ID NO: 19585 - DNA, 23 bp, Artificial Sequence
  Synthetic
ccgttttttttttttctctggtc

SEQ ID NO: 19586 - DNA, 23 bp, Artificial Sequence
  Synthetic
ccgttttttttttttcataggaa

SEQ ID NO: 19587 - DNA, 23 bp, Artificial Sequence
  Synthetic
ccgttttttttttttatcatcaa

SEQ ID NO: 19588 - DNA, 23 bp, Artificial Sequence
  Synthetic
ccgttttttttttttatctttac

SEQ ID NO: 19589 - DNA, 23 bp, Artificial Sequence
  Synthetic
ccgttttttttttttgctacagt

SEQ ID NO: 19590 - DNA, 23 bp, Artificial Sequence
  Synthetic
ccgttttttttttttgtacatca

SEQ ID NO: 19591 - DNA, 23 bp, Artificial Sequence
  Synthetic
ccgttttttttttttgggattcc

SEQ ID NO: 19592 - DNA, 23 bp, Artificial Sequence
  Synthetic
ccgttttttttttttagaagcat

SEQ ID NO: 19593 - DNA, 23 bp, Artificial Sequence
  Synthetic
ccgttttttttttttcttttgtg

SEQ ID NO: 19594 - DNA, 23 bp, Artificial Sequence
  Synthetic
ccgttttttttttttaaggcaac

SEQ ID NO: 19595 - DNA, 23 bp, Artificial Sequence
  Synthetic
ccgttttttttttttcaaaccat

SEQ ID NO: 19596 - DNA, 23 bp, Artificial Sequence
  Synthetic
ccgttttttttttttaaccatga

SEQ ID NO: 19597 - DNA, 23 bp, Artificial Sequence
  Synthetic
ccgttttttttttttccaatatt

SEQ ID NO: 19598 - DNA, 23 bp, Artificial Sequence
  Synthetic
ccgttttttttttttaagtgcct

SEQ ID NO: 19599 - DNA, 23 bp, Artificial Sequence
  Synthetic
ccgttttttttttttacctgcac

SEQ ID NO: 19600 - DNA, 23 bp, Artificial Sequence
  Synthetic
ccgttttttttttttgcactaga

SEQ ID NO: 19601 - DNA, 23 bp, Artificial Sequence
  Synthetic
ccgttttttttttttcaccgaca

SEQ ID NO: 19602 - DNA, 23 bp, Artificial Sequence
  Synthetic
ccgttttttttttttacaatcaa

SEQ ID NO: 19603 - DNA, 23 bp, Artificial Sequence
  Synthetic
ccgttttttttttttcccaccga

SEQ ID NO: 19604 - DNA, 23 bp, Artificial Sequence
  Synthetic
ccgttttttttttttagttctac

SEQ ID NO: 19605 - DNA, 23 bp, Artificial Sequence
  Synthetic
ccgttttttttttttccttatca

SEQ ID NO: 19606 - DNA, 23 bp, Artificial Sequence
  Synthetic
ccgttttttttttttgctgcaac

SEQ ID NO: 19607 - DNA, 23 bp, Artificial Sequence
  Synthetic
ccgttttttttttttcctccacc

SEQ ID NO: 19608 - DNA, 23 bp, Artificial Sequence
  Synthetic
ccgttttttttttttgatatcag

SEQ ID NO: 19609 - DNA, 23 bp, Artificial Sequence
  Synthetic
ccgttttttttttttacatggag

SEQ ID NO: 19610 - DNA, 23 bp, Artificial Sequence
  Synthetic
ccgttttttttttttaacaacat

SEQ ID NO: 19611 - DNA, 23 bp, Artificial Sequence
  Synthetic
ccgttttttttttttcaacaaca

SEQ ID NO: 19612 - DNA, 23 bp, Artificial Sequence
  Synthetic
ccgttttttttttttgggtggag

SEQ ID NO: 19613 - DNA, 23 bp, Artificial Sequence
  Synthetic
ccgttttttttttttatctcccc

SEQ ID NO: 19614 - DNA, 23 bp, Artificial Sequence
  Synthetic
ccgttttttttttttacaggtag

SEQ ID NO: 19615 - DNA, 23 bp, Artificial Sequence
  Synthetic
ccgttttttttttttgttttgca

SEQ ID NO: 19616 - DNA, 23 bp, Artificial Sequence
  Synthetic
ccgttttttttttttgttttgca

SEQ ID NO: 19617 - DNA, 23 bp, Artificial Sequence
  Synthetic
ccgttttttttttttctgcacta

SEQ ID NO: 19618 - DNA, 23 bp, Artificial Sequence
  Synthetic
ccgttttttttttttatcattac

SEQ ID NO: 19619 - DNA, 23 bp, Artificial Sequence
  Synthetic
ccgttttttttttttgcatagga

SEQ ID NO: 19620 - DNA, 23 bp, Artificial Sequence
  Synthetic
ccgttttttttttttacacactt

SEQ ID NO: 19621 - DNA, 23 bp, Artificial Sequence
  Synthetic
ccgttttttttttttacatcagt

SEQ ID NO: 19622 - DNA, 23 bp, Artificial Sequence
  Synthetic
ccgttttttttttttgcgaagga

SEQ ID NO: 19623 - DNA, 23 bp, Artificial Sequence
  Synthetic
ccgttttttttttttcctgtctg

SEQ ID NO: 19624 - DNA, 23 bp, Artificial Sequence
  Synthetic
ccgttttttttttttgtcaattc

SEQ ID NO: 19625 - DNA, 23 bp, Artificial Sequence
  Synthetic
ccgttttttttttttcagttgcc

SEQ ID NO: 19626 - DNA, 23 bp, Artificial Sequence
  Synthetic
ccgttttttttttttatggttag

SEQ ID NO: 19627 - DNA, 23 bp, Artificial Sequence
  Synthetic
ccgttttttttttttaattgcgt

SEQ ID NO: 19628 - DNA, 23 bp, Artificial Sequence
  Synthetic
ccgttttttttttttagttcttc

SEQ ID NO: 19629 - DNA, 23 bp, Artificial Sequence
  Synthetic
ccgttttttttttttaacccagc

SEQ ID NO: 19630 - DNA, 23 bp, Artificial Sequence
  Synthetic
ccgttttttttttttggtatttg

SEQ ID NO: 19631 - DNA, 23 bp, Artificial Sequence
  Synthetic
ccgttttttttttttacggaacc

SEQ ID NO: 19632 - DNA, 23 bp, Artificial Sequence
  Synthetic
ccgttttttttttttaaatccct

SEQ ID NO: 19633 - DNA, 23 bp, Artificial Sequence
  Synthetic
ccgttttttttttttgtaatccc

SEQ ID NO: 19634 - DNA, 23 bp, Artificial Sequence
  Synthetic
ccgttttttttttttcctgctga

SEQ ID NO: 19635 - DNA, 23 bp, Artificial Sequence
  Synthetic
ccgttttttttttttgaccgaga

SEQ ID NO: 19636 - DNA, 23 bp, Artificial Sequence
  Synthetic
ccgttttttttttttcctatcct

SEQ ID NO: 19637 - DNA, 23 bp, Artificial Sequence
  Synthetic
ccgttttttttttttcggaactt

SEQ ID NO: 19638 - DNA, 23 bp, Artificial Sequence
  Synthetic
ccgttttttttttttaatagact

SEQ ID NO: 19639 - DNA, 23 bp, Artificial Sequence
  Synthetic
ccgttttttttttttccgatttc

SEQ ID NO: 19640 - DNA, 23 bp, Artificial Sequence
  Synthetic
ccgttttttttttttgatttcaa

SEQ ID NO: 19641 - DNA, 23 bp, Artificial Sequence
  Synthetic
ccgttttttttttttgcaaacat

SEQ ID NO: 19642 - DNA, 23 bp, Artificial Sequence
  Synthetic
ccgttttttttttttcagtcgag

SEQ ID NO: 19643 - DNA, 23 bp, Artificial Sequence
  Synthetic
ccgttttttttttttgctatgcc

SEQ ID NO: 19644 - DNA, 23 bp, Artificial Sequence
  Synthetic
ccgttttttttttttaacttagt

SEQ ID NO: 19645 - DNA, 23 bp, Artificial Sequence
  Synthetic
ccgttttttttttttatgcaact

SEQ ID NO: 19646 - DNA, 23 bp, Artificial Sequence
  Synthetic
ccgttttttttttttaaccagct

SEQ ID NO: 19647 - DNA, 23 bp, Artificial Sequence
  Synthetic
ccgttttttttttttcaaaatca

SEQ ID NO: 19648 - DNA, 23 bp, Artificial Sequence
  Synthetic
ccgttttttttttttaggccggg

SEQ ID NO: 19649 - DNA, 23 bp, Artificial Sequence
  Synthetic
ccgttttttttttttcctgcacg

SEQ ID NO: 19650 - DNA, 23 bp, Artificial Sequence
  Synthetic
ccgttttttttttttcaataaat

SEQ ID NO: 19651 - DNA, 23 bp, Artificial Sequence
  Synthetic
ccgttttttttttttcaatacaa

SEQ ID NO: 19652 - DNA, 23 bp, Artificial Sequence
  Synthetic
ccgttttttttttttcaagatcg

SEQ ID NO: 19653 - DNA, 23 bp, Artificial Sequence
  Synthetic
ccgttttttttttttctcactct

SEQ ID NO: 19654 - DNA, 23 bp, Artificial Sequence
  Synthetic
ccgttttttttttttctcactct

SEQ ID NO: 19655 - DNA, 23 bp, Artificial Sequence
  Synthetic
ccgttttttttttttctcactct

SEQ ID NO: 19656 - DNA, 23 bp, Artificial Sequence
  Synthetic
ccgttttttttttttctcactct

SEQ ID NO: 19657 - DNA, 23 bp, Artificial Sequence
  Synthetic
ccgttttttttttttctcactct

SEQ ID NO: 19658 - DNA, 23 bp, Artificial Sequence
  Synthetic
ccgttttttttttttctcactct

SEQ ID NO: 19659 - DNA, 23 bp, Artificial Sequence
  Synthetic
ccgttttttttttttctctctat

SEQ ID NO: 19660 - DNA, 23 bp, Artificial Sequence
  Synthetic
ccgttttttttttttctctctat

SEQ ID NO: 19661 - DNA, 23 bp, Artificial Sequence
  Synthetic
ccgttttttttttttctctctat

SEQ ID NO: 19662 - DNA, 23 bp, Artificial Sequence
  Synthetic
ccgttttttttttttctctctat

SEQ ID NO: 19663 - DNA, 23 bp, Artificial Sequence
  Synthetic
ccgttttttttttttctccctct

SEQ ID NO: 19664 - DNA, 23 bp, Artificial Sequence
  Synthetic
ccgttttttttttttagctccct

SEQ ID NO: 19665 - DNA, 23 bp, Artificial Sequence
  Synthetic
ccgttttttttttttagctccct

SEQ ID NO: 19666 - DNA, 23 bp, Artificial Sequence
  Synthetic
ccgttttttttttttagctccct

SEQ ID NO: 19667 - DNA, 23 bp, Artificial Sequence
  Synthetic
ccgttttttttttttgagctccc

SEQ ID NO: 19668 - DNA, 23 bp, Artificial Sequence
  Synthetic
ccgttttttttttttgagctccc

SEQ ID NO: 19669 - DNA, 23 bp, Artificial Sequence
  Synthetic
ccgttttttttttttagctccct

SEQ ID NO: 19670 - DNA, 23 bp, Artificial Sequence
  Synthetic
ccgttttttttttttcatacagg

SEQ ID NO: 19671 - DNA, 23 bp, Artificial Sequence
  Synthetic
ccgttttttttttttcatacagg

SEQ ID NO: 19672 - DNA, 23 bp, Artificial Sequence
  Synthetic
ccgttttttttttttcatacagg

SEQ ID NO: 19673 - DNA, 23 bp, Artificial Sequence
  Synthetic
ccgttttttttttttcatacagg

SEQ ID NO: 19674 - DNA, 23 bp, Artificial Sequence
  Synthetic
ccgttttttttttttcattcagg

SEQ ID NO: 19675 - DNA, 23 bp, Artificial Sequence
  Synthetic
ccgttttttttttttcattcagg

SEQ ID NO: 19676 - DNA, 23 bp, Artificial Sequence
  Synthetic
ccgttttttttttttcatccagg

SEQ ID NO: 19677 - DNA, 23 bp, Artificial Sequence
  Synthetic
ccgttttttttttttcatgcagg

SEQ ID NO: 19678 - DNA, 23 bp, Artificial Sequence
  Synthetic
ccgttttttttttttgatgcaga

SEQ ID NO: 19679 - DNA, 23 bp, Artificial Sequence
  Synthetic
ccgttttttttttttgatgcaga

SEQ ID NO: 19680 - DNA, 23 bp, Artificial Sequence
  Synthetic
ccgttttttttttttgatgcaga

SEQ ID NO: 19681 - DNA, 23 bp, Artificial Sequence
  Synthetic
ccgttttttttttttacgtgccc

SEQ ID NO: 19682 - DNA, 23 bp, Artificial Sequence
  Synthetic
ccgttttttttttttacgtgccc

SEQ ID NO: 19683 - DNA, 23 bp, Artificial Sequence
  Synthetic
ccgttttttttttttacgtgccc

SEQ ID NO: 19684 - DNA, 23 bp, Artificial Sequence
  Synthetic
ccgttttttttttttacgtgccc

SEQ ID NO: 19685 - DNA, 23 bp, Artificial Sequence
  Synthetic
ccgttttttttttttacgtgccc

SEQ ID NO: 19686 - DNA, 23 bp, Artificial Sequence
  Synthetic
ccgttttttttttttcatgtgcc

SEQ ID NO: 19687 - DNA, 23 bp, Artificial Sequence
  Synthetic
ccgttttttttttttggaatgaa

SEQ ID NO: 19688 - DNA, 23 bp, Artificial Sequence
  Synthetic
ccgttttttttttttggaatgaa

SEQ ID NO: 19689 - DNA, 23 bp, Artificial Sequence
  Synthetic
ccgttttttttttttggaatgaa

SEQ ID NO: 19690 - DNA, 23 bp, Artificial Sequence
  Synthetic
ccgttttttttttttggaatgaa

SEQ ID NO: 19691 - DNA, 23 bp, Artificial Sequence
  Synthetic
ccgttttttttttttggaatgaa

SEQ ID NO: 19692 - DNA, 23 bp, Artificial Sequence
  Synthetic
ccgttttttttttttggaatgaa

SEQ ID NO: 19693 - DNA, 23 bp, Artificial Sequence
  Synthetic
ccgttttttttttttggaatgaa

SEQ ID NO: 19694 - DNA, 23 bp, Artificial Sequence
  Synthetic
ccgttttttttttttggaatgaa

SEQ ID NO: 19695 - DNA, 23 bp, Artificial Sequence
  Synthetic
ccgttttttttttttggaatgaa

SEQ ID NO: 19696 - DNA, 23 bp, Artificial Sequence
  Synthetic
ccgttttttttttttggaatgaa

SEQ ID NO: 19697 - DNA, 23 bp, Artificial Sequence
  Synthetic
ccgttttttttttttggaatgaa

SEQ ID NO: 19698 - DNA, 23 bp, Artificial Sequence
  Synthetic
ccgttttttttttttggaatgaa

SEQ ID NO: 19699 - DNA, 23 bp, Artificial Sequence
  Synthetic
ccgttttttttttttggaatgaa

SEQ ID NO: 19700 - DNA, 23 bp, Artificial Sequence
  Synthetic
ccgttttttttttttggaatgaa

SEQ ID NO: 19701 - DNA, 23 bp, Artificial Sequence
  Synthetic
ccgttttttttttttggaatgaa

SEQ ID NO: 19702 - DNA, 23 bp, Artificial Sequence
  Synthetic
ccgttttttttttttggaatgga

SEQ ID NO: 19703 - DNA, 23 bp, Artificial Sequence
  Synthetic
ccgttttttttttttggaatgaa

SEQ ID NO: 19704 - DNA, 23 bp, Artificial Sequence
  Synthetic
ccgttttttttttttatcatgct

SEQ ID NO: 19705 - DNA, 23 bp, Artificial Sequence
  Synthetic
ccgttttttttttttatcatgct

SEQ ID NO: 19706 - DNA, 23 bp, Artificial Sequence
  Synthetic
ccgttttttttttttatcatgct

SEQ ID NO: 19707 - DNA, 23 bp, Artificial Sequence
  Synthetic
ccgttttttttttttatcatgct

SEQ ID NO: 19708 - DNA, 23 bp, Artificial Sequence
  Synthetic
ccgttttttttttttgatcatgc

SEQ ID NO: 19709 - DNA, 23 bp, Artificial Sequence
  Synthetic
ccgttttttttttttgatcatgc

SEQ ID NO: 19710 - DNA, 23 bp, Artificial Sequence
  Synthetic
ccgttttttttttttgatcatgc

SEQ ID NO: 19711 - DNA, 23 bp, Artificial Sequence
  Synthetic
ccgttttttttttttgatcatgt

SEQ ID NO: 19712 - DNA, 23 bp, Artificial Sequence
  Synthetic
ccgttttttttttttcgacctgc

SEQ ID NO: 19713 - DNA, 23 bp, Artificial Sequence
  Synthetic
ccgttttttttttttcgacctgc

SEQ ID NO: 19714 - DNA, 23 bp, Artificial Sequence
  Synthetic
ccgttttttttttttgcaagtca

SEQ ID NO: 19715 - DNA, 23 bp, Artificial Sequence
  Synthetic
ccgttttttttttttgacaagtc

SEQ ID NO: 19716 - DNA, 23 bp, Artificial Sequence
  Synthetic
ccgttttttttttttgcaagtcg

SEQ ID NO: 19717 - DNA, 23 bp, Artificial Sequence
  Synthetic
ccgttttttttttttgcaagtcg

SEQ ID NO: 19718 - DNA, 23 bp, Artificial Sequence
  Synthetic
ccgttttttttttttgcaagtcg

SEQ ID NO: 19719 - DNA, 23 bp, Artificial Sequence
  Synthetic
ccgttttttttttttgcaagtcg

SEQ ID NO: 19720 - DNA, 23 bp, Artificial Sequence
  Synthetic
ccgttttttttttttgcaagtcg

SEQ ID NO: 19721 - DNA, 23 bp, Artificial Sequence
  Synthetic
ccgttttttttttttgcaagtca

SEQ ID NO: 19722 - DNA, 23 bp, Artificial Sequence
  Synthetic
ccgttttttttttttgcaagtca

SEQ ID NO: 19723 - DNA, 23 bp, Artificial Sequence
  Synthetic
ccgttttttttttttggcaagtc

SEQ ID NO: 19724 - DNA, 23 bp, Artificial Sequence
  Synthetic
ccgttttttttttttggcaagtc

SEQ ID NO: 19725 - DNA, 23 bp, Artificial Sequence
  Synthetic
ccgttttttttttttggcaagtc

SEQ ID NO: 19726 - DNA, 23 bp, Artificial Sequence
  Synthetic
ccgttttttttttttggcaagtc

SEQ ID NO: 19727 - DNA, 23 bp, Artificial Sequence
  Synthetic
ccgttttttttttttggcaagtc

SEQ ID NO: 19728 - DNA, 23 bp, Artificial Sequence
  Synthetic
ccgttttttttttttggcaagtc

SEQ ID NO: 19729 - DNA, 23 bp, Artificial Sequence
  Synthetic
ccgttttttttttttggcaagtc

SEQ ID NO: 19730 - DNA, 23 bp, Artificial Sequence
  Synthetic
ccgttttttttttttggcaagtc

SEQ ID NO: 19731 - DNA, 23 bp, Artificial Sequence
  Synthetic
ccgttttttttttttggcaagtc

SEQ ID NO: 19732 - DNA, 23 bp, Artificial Sequence
  Synthetic
ccgttttttttttttggcaagtc

SEQ ID NO: 19733 - DNA, 23 bp, Artificial Sequence
  Synthetic
ccgttttttttttttgcaagtca

SEQ ID NO: 19734 - DNA, 23 bp, Artificial Sequence
  Synthetic
ccgttttttttttttggcaagtc

SEQ ID NO: 19735 - DNA, 23 bp, Artificial Sequence
  Synthetic
ccgttttttttttttggcaagtc

SEQ ID NO: 19736 - DNA, 23 bp, Artificial Sequence
  Synthetic
ccgttttttttttttggcaagtc

SEQ ID NO: 19737 - DNA, 23 bp, Artificial Sequence
  Synthetic
ccgttttttttttttgcaagtca

SEQ ID NO: 19738 - DNA, 23 bp, Artificial Sequence
  Synthetic
ccgttttttttttttgcaagtca

SEQ ID NO: 19739 - DNA, 23 bp, Artificial Sequence
  Synthetic
ccgttttttttttttggcaagtc

SEQ ID NO: 19740 - DNA, 23 bp, Artificial Sequence
  Synthetic
ccgttttttttttttgcaagtcg

SEQ ID NO: 19741 - DNA, 23 bp, Artificial Sequence
  Synthetic
ccgttttttttttttgcaagtca

SEQ ID NO: 19742 - DNA, 23 bp, Artificial Sequence
  Synthetic
ccgttttttttttttgcaagtca

SEQ ID NO: 19743 - DNA, 23 bp, Artificial Sequence
  Synthetic
ccgttttttttttttagcaagtc

SEQ ID NO: 19744 - DNA, 23 bp, Artificial Sequence
  Synthetic
ccgttttttttttttggcaattc

SEQ ID NO: 19745 - DNA, 23 bp, Artificial Sequence
  Synthetic
ccgttttttttttttggcaaatc

SEQ ID NO: 19746 - DNA, 23 bp, Artificial Sequence
  Synthetic
ccgttttttttttttgatattgg

SEQ ID NO: 19747 - DNA, 23 bp, Artificial Sequence
  Synthetic
ccgttttttttttttgatattgg

SEQ ID NO: 19748 - DNA, 23 bp, Artificial Sequence
  Synthetic
ccgttttttttttttattggcgc

SEQ ID NO: 19749 - DNA, 23 bp, Artificial Sequence
  Synthetic
ccgttttttttttttattggcgc

SEQ ID NO: 19750 - DNA, 23 bp, Artificial Sequence
  Synthetic
ccgttttttttttttattggcac

SEQ ID NO: 19751 - DNA, 23 bp, Artificial Sequence
  Synthetic
ccgttttttttttttattggcac

SEQ ID NO: 19752 - DNA, 23 bp, Artificial Sequence
  Synthetic
ccgttttttttttttattggcac

SEQ ID NO: 19753 - DNA, 23 bp, Artificial Sequence
  Synthetic
ccgttttttttttttattggcac

SEQ ID NO: 19754 - DNA, 23 bp, Artificial Sequence
  Synthetic
ccgttttttttttttattggcac

SEQ ID NO: 19755 - DNA, 23 bp, Artificial Sequence
  Synthetic
ccgttttttttttttattggcgc

SEQ ID NO: 19756 - DNA, 23 bp, Artificial Sequence
  Synthetic
ccgttttttttttttattggcgc

SEQ ID NO: 19757 - DNA, 23 bp, Artificial Sequence
  Synthetic
ccgttttttttttttcagcatca

SEQ ID NO: 19758 - DNA, 23 bp, Artificial Sequence
  Synthetic
ccgttttttttttttcagcatca

SEQ ID NO: 19759 - DNA, 23 bp, Artificial Sequence
  Synthetic
ccgttttttttttttcagcatca

SEQ ID NO: 19760 - DNA, 23 bp, Artificial Sequence
  Synthetic
ccgttttttttttttcagcatca

SEQ ID NO: 19761 - DNA, 23 bp, Artificial Sequence
  Synthetic
ccgttttttttttttcagcatca

SEQ ID NO: 19762 - DNA, 23 bp, Artificial Sequence
  Synthetic
ccgttttttttttttcagcatca

SEQ ID NO: 19763 - DNA, 23 bp, Artificial Sequence
  Synthetic
ccgttttttttttttcagcatca

SEQ ID NO: 19764 - DNA, 23 bp, Artificial Sequence
  Synthetic
ccgttttttttttttcagcatca

SEQ ID NO: 19765 - DNA, 23 bp, Artificial Sequence
  Synthetic
ccgttttttttttttagcatcat

SEQ ID NO: 19766 - DNA, 23 bp, Artificial Sequence
  Synthetic
ccgttttttttttttgagctccc

SEQ ID NO: 19767 - DNA, 23 bp, Artificial Sequence
  Synthetic
ccgttttttttttttgagctccc

SEQ ID NO: 19768 - DNA, 23 bp, Artificial Sequence
  Synthetic
ccgttttttttttttgagctccc

SEQ ID NO: 19769 - DNA, 23 bp, Artificial Sequence
  Synthetic
ccgttttttttttttgagctccc

SEQ ID NO: 19770 - DNA, 23 bp, Artificial Sequence
  Synthetic
ccgttttttttttttgagctccc

SEQ ID NO: 19771 - DNA, 23 bp, Artificial Sequence
  Synthetic
ccgttttttttttttgagctccc

SEQ ID NO: 19772 - DNA, 23 bp, Artificial Sequence
  Synthetic
ccgttttttttttttgagctccc

SEQ ID NO: 19773 - DNA, 23 bp, Artificial Sequence
  Synthetic
ccgttttttttttttgagctccc

SEQ ID NO: 19774 - DNA, 23 bp, Artificial Sequence
  Synthetic
ccgttttttttttttgagctccc

SEQ ID NO: 19775 - DNA, 23 bp, Artificial Sequence
  Synthetic
ccgttttttttttttcgctatcc

SEQ ID NO: 19776 - DNA, 23 bp, Artificial Sequence
  Synthetic
ccgttttttttttttcgctatcc

SEQ ID NO: 19777 - DNA, 23 bp, Artificial Sequence
  Synthetic
ccgttttttttttttcgctatcc

SEQ ID NO: 19778 - DNA, 23 bp, Artificial Sequence
  Synthetic
ccgttttttttttttcgctatcc

SEQ ID NO: 19779 - DNA, 23 bp, Artificial Sequence
  Synthetic
ccgttttttttttttcaatgcga

SEQ ID NO: 19780 - DNA, 23 bp, Artificial Sequence
  Synthetic
ccgttttttttttttcaatgcga

SEQ ID NO: 19781 - DNA, 23 bp, Artificial Sequence
  Synthetic
ccgttttttttttttcaatgcga

SEQ ID NO: 19782 - DNA, 23 bp, Artificial Sequence
  Synthetic
ccgttttttttttttcaatgcga

SEQ ID NO: 19783 - DNA, 23 bp, Artificial Sequence
  Synthetic
ccgttttttttttttaggtggac

SEQ ID NO: 19784 - DNA, 23 bp, Artificial Sequence
  Synthetic
ccgttttttttttttaggtggac

SEQ ID NO: 19785 - DNA, 23 bp, Artificial Sequence
  Synthetic
ccgttttttttttttgttcctcc

SEQ ID NO: 19786 - DNA, 23 bp, Artificial Sequence
  Synthetic
ccgttttttttttttgttccccc

SEQ ID NO: 19787 - DNA, 23 bp, Artificial Sequence
  Synthetic
ccgttttttttttttgttccccc

SEQ ID NO: 19788 - DNA, 23 bp, Artificial Sequence
  Synthetic
ccgttttttttttttgttccccc

SEQ ID NO: 19789 - DNA, 23 bp, Artificial Sequence
  Synthetic
ccgttttttttttttgttccccc

SEQ ID NO: 19790 - DNA, 23 bp, Artificial Sequence
  Synthetic
ccgttttttttttttgttccccc

SEQ ID NO: 19791 - DNA, 23 bp, Artificial Sequence
  Synthetic
ccgttttttttttttgttccccc

SEQ ID NO: 19792 - DNA, 23 bp, Artificial Sequence
  Synthetic
ccgttttttttttttgttccccc

SEQ ID NO: 19793 - DNA, 23 bp, Artificial Sequence
  Synthetic
ccgttttttttttttgttccccc

SEQ ID NO: 19794 - DNA, 23 bp, Artificial Sequence
  Synthetic
ccgttttttttttttgttccccc

SEQ ID NO: 19795 - DNA, 23 bp, Artificial Sequence
  Synthetic
ccgttttttttttttgttcaaga

SEQ ID NO: 19796 - DNA, 23 bp, Artificial Sequence
  Synthetic
ccgttttttttttttgttcaaga

SEQ ID NO: 19797 - DNA, 23 bp, Artificial Sequence
  Synthetic
ccgttttttttttttgttcaaga

SEQ ID NO: 19798 - DNA, 23 bp, Artificial Sequence
  Synthetic
ccgttttttttttttgttcaaga

SEQ ID NO: 19799 - DNA, 23 bp, Artificial Sequence
  Synthetic
ccgttttttttttttgttcaaga

SEQ ID NO: 19800 - DNA, 23 bp, Artificial Sequence
  Synthetic
ccgttttttttttttgttcaaga

SEQ ID NO: 19801 - DNA, 23 bp, Artificial Sequence
  Synthetic
ccgttttttttttttgttcaaga

SEQ ID NO: 19802 - DNA, 23 bp, Artificial Sequence
  Synthetic
ccgttttttttttttcaacgctg

SEQ ID NO: 19803 - DNA, 23 bp, Artificial Sequence
  Synthetic
ccgttttttttttttcaacgctg

SEQ ID NO: 19804 - DNA, 23 bp, Artificial Sequence
  Synthetic
ccgttttttttttttcaaagctc

SEQ ID NO: 19805 - DNA, 23 bp, Artificial Sequence
  Synthetic
ccgttttttttttttggggtgac

SEQ ID NO: 19806 - DNA, 23 bp, Artificial Sequence
  Synthetic
ccgttttttttttttggggcgac

SEQ ID NO: 19807 - DNA, 23 bp, Artificial Sequence
  Synthetic
ccgttttttttttttggggcgac

SEQ ID NO: 19808 - DNA, 23 bp, Artificial Sequence
  Synthetic
ccgttttttttttttgggcaaat

SEQ ID NO: 19809 - DNA, 23 bp, Artificial Sequence
  Synthetic
ccgttttttttttttgggcaaat

SEQ ID NO: 19810 - DNA, 23 bp, Artificial Sequence
  Synthetic
ccgttttttttttttgggcaaat

SEQ ID NO: 19811 - DNA, 23 bp, Artificial Sequence
  Synthetic
ccgttttttttttttgggcaaat

SEQ ID NO: 19812 - DNA, 23 bp, Artificial Sequence
  Synthetic
ccgttttttttttttgggcaaat

SEQ ID NO: 19813 - DNA, 23 bp, Artificial Sequence
  Synthetic
ccgttttttttttttgggcaatt

SEQ ID NO: 19814 - DNA, 23 bp, Artificial Sequence
  Synthetic
ccgttttttttttttgggcaatt

SEQ ID NO: 19815 - DNA, 23 bp, Artificial Sequence
  Synthetic
ccgttttttttttttgggaaact

SEQ ID NO: 19816 - DNA, 23 bp, Artificial Sequence
  Synthetic
ccgttttttttttttggcaactc

SEQ ID NO: 19817 - DNA, 23 bp, Artificial Sequence
  Synthetic
ccgttttttttttttggacaaat

SEQ ID NO: 19818 - DNA, 23 bp, Artificial Sequence
  Synthetic
ccgttttttttttttagcaaatc

SEQ ID NO: 19819 - DNA, 23 bp, Artificial Sequence
  Synthetic
ccgttttttttttttgggcaact

SEQ ID NO: 19820 - DNA, 23 bp, Artificial Sequence
  Synthetic
ccgttttttttttttagtttgtg

SEQ ID NO: 19821 - DNA, 23 bp, Artificial Sequence
  Synthetic
ccgttttttttttttagtttgtg

SEQ ID NO: 19822 - DNA, 23 bp, Artificial Sequence
  Synthetic
ccgttttttttttttagtttgtg

SEQ ID NO: 19823 - DNA, 23 bp, Artificial Sequence
  Synthetic
ccgttttttttttttcagggaag

SEQ ID NO: 19824 - DNA, 23 bp, Artificial Sequence
  Synthetic
ccgttttttttttttgatgggtg

SEQ ID NO: 19825 - DNA, 23 bp, Artificial Sequence
  Synthetic
ccgttttttttttttgatgggtg

SEQ ID NO: 19826 - DNA, 23 bp, Artificial Sequence
  Synthetic
ccgttttttttttttaagccttg

SEQ ID NO: 19827 - DNA, 23 bp, Artificial Sequence
  Synthetic
ccgttttttttttttaagccctg

SEQ ID NO: 19828 - DNA, 23 bp, Artificial Sequence
  Synthetic
ccgttttttttttttcagccaaa

SEQ ID NO: 19829 - DNA, 23 bp, Artificial Sequence
  Synthetic
ccgttttttttttttcagccaaa

SEQ ID NO: 19830 - DNA, 23 bp, Artificial Sequence
  Synthetic
ccgttttttttttttcagccaaa

SEQ ID NO: 19831 - DNA, 23 bp, Artificial Sequence
  Synthetic
ccgttttttttttttatcaatgg

SEQ ID NO: 19832 - DNA, 23 bp, Artificial Sequence
  Synthetic
ccgttttttttttttatcaatgg

SEQ ID NO: 19833 - DNA, 23 bp, Artificial Sequence
  Synthetic
ccgttttttttttttatcaatgg

SEQ ID NO: 19834 - DNA, 23 bp, Artificial Sequence
  Synthetic
ccgttttttttttttatcaatgg

SEQ ID NO: 19835 - DNA, 23 bp, Artificial Sequence
  Synthetic
ccgttttttttttttcaaagaag

SEQ ID NO: 19836 - DNA, 23 bp, Artificial Sequence
  Synthetic
ccgttttttttttttaaagaaga

SEQ ID NO: 19837 - DNA, 23 bp, Artificial Sequence
  Synthetic
ccgttttttttttttaaagaaga

SEQ ID NO: 19838 - DNA, 23 bp, Artificial Sequence
  Synthetic
ccgttttttttttttaagcctct

SEQ ID NO: 19839 - DNA, 23 bp, Artificial Sequence
  Synthetic
ccgttttttttttttaagcctct

SEQ ID NO: 19840 - DNA, 23 bp, Artificial Sequence
  Synthetic
ccgttttttttttttctaaaaat

SEQ ID NO: 19841 - DNA, 23 bp, Artificial Sequence
  Synthetic
ccgttttttttttttctaaaaat

SEQ ID NO: 19842 - DNA, 23 bp, Artificial Sequence
  Synthetic
ccgttttttttttttctaaaaat

SEQ ID NO: 19843 - DNA, 23 bp, Artificial Sequence
  Synthetic
ccgttttttttttttaaaaatag

SEQ ID NO: 19844 - DNA, 23 bp, Artificial Sequence
  Synthetic
ccgttttttttttttctaaaaat

SEQ ID NO: 19845 - DNA, 23 bp, Artificial Sequence
  Synthetic
ccgttttttttttttctaaaaat

SEQ ID NO: 19846 - DNA, 23 bp, Artificial Sequence
  Synthetic
ccgttttttttttttctaaaaat

SEQ ID NO: 19847 - DNA, 23 bp, Artificial Sequence
  Synthetic
ccgttttttttttttctaaaaat

SEQ ID NO: 19848 - DNA, 23 bp, Artificial Sequence
  Synthetic
ccgttttttttttttctaaaaat

SEQ ID NO: 19849 - DNA, 23 bp, Artificial Sequence
  Synthetic
ccgttttttttttttctaaaaat

SEQ ID NO: 19850 - DNA, 23 bp, Artificial Sequence
  Synthetic
ccgttttttttttttctaaaaat

SEQ ID NO: 19851 - DNA, 23 bp, Artificial Sequence
  Synthetic
ccgttttttttttttctaaaaat

SEQ ID NO: 19852 - DNA, 23 bp, Artificial Sequence
  Synthetic
ccgttttttttttttctaaaaat

SEQ ID NO: 19853 - DNA, 23 bp, Artificial Sequence
  Synthetic
ccgttttttttttttctaaaaat

SEQ ID NO: 19854 - DNA, 23 bp, Artificial Sequence
  Synthetic
ccgttttttttttttctaaaaat

SEQ ID NO: 19855 - DNA, 23 bp, Artificial Sequence
  Synthetic
ccgttttttttttttctaaaaat

SEQ ID NO: 19856 - DNA, 23 bp, Artificial Sequence
  Synthetic
ccgttttttttttttctaaaaat

SEQ ID NO: 19857 - DNA, 23 bp, Artificial Sequence
  Synthetic
ccgttttttttttttctaaaaat

SEQ ID NO: 19858 - DNA, 23 bp, Artificial Sequence
  Synthetic
ccgttttttttttttctaaaaat

SEQ ID NO: 19859 - DNA, 23 bp, Artificial Sequence
  Synthetic
ccgttttttttttttgagccgga

SEQ ID NO: 19860 - DNA, 23 bp, Artificial Sequence
  Synthetic
ccgttttttttttttaacgtcaa

SEQ ID NO: 19861 - DNA, 23 bp, Artificial Sequence
  Synthetic
ccgttttttttttttaacatcaa

SEQ ID NO: 19862 - DNA, 23 bp, Artificial Sequence
  Synthetic
ccgttttttttttttaagctgtt

SEQ ID NO: 19863 - DNA, 23 bp, Artificial Sequence
  Synthetic
ccgttttttttttttaagctgtt

SEQ ID NO: 19864 - DNA, 23 bp, Artificial Sequence
  Synthetic
ccgttttttttttttaagctgtt

SEQ ID NO: 19865 - DNA, 23 bp, Artificial Sequence
  Synthetic
ccgttttttttttttaagctgtt

SEQ ID NO: 19866 - DNA, 23 bp, Artificial Sequence
  Synthetic
ccgttttttttttttaagctgtt

SEQ ID NO: 19867 - DNA, 23 bp, Artificial Sequence
  Synthetic
ccgttttttttttttaatgggag

SEQ ID NO: 19868 - DNA, 23 bp, Artificial Sequence
  Synthetic
ccgttttttttttttcaagttcg

SEQ ID NO: 19869 - DNA, 23 bp, Artificial Sequence
  Synthetic
ccgttttttttttttagttatca

SEQ ID NO: 19870 - DNA, 23 bp, Artificial Sequence
  Synthetic
ccgttttttttttttagccctgt

SEQ ID NO: 19871 - DNA, 23 bp, Artificial Sequence
  Synthetic
ccgttttttttttttaggagtct

SEQ ID NO: 19872 - DNA, 23 bp, Artificial Sequence
  Synthetic
ccgttttttttttttacctgcac

SEQ ID NO: 19873 - DNA, 23 bp, Artificial Sequence
  Synthetic
ccgttttttttttttgcactgtc

SEQ ID NO: 19874 - DNA, 23 bp, Artificial Sequence
  Synthetic
ccgttttttttttttagccctgt

SEQ ID NO: 19875 - DNA, 23 bp, Artificial Sequence
  Synthetic
ccgttttttttttttcattcacc

SEQ ID NO: 19876 - DNA, 23 bp, Artificial Sequence
  Synthetic
ccgttttttttttttcaagttag

SEQ ID NO: 19877 - DNA, 23 bp, Artificial Sequence
  Synthetic
ccgttttttttttttccaagctc

SEQ ID NO: 19878 - DNA, 23 bp, Artificial Sequence
  Synthetic
ccgttttttttttttaagagacc

SEQ ID NO: 19879 - DNA, 23 bp, Artificial Sequence
  Synthetic
ccgttttttttttttgctggttg

SEQ ID NO: 19880 - DNA, 23 bp, Artificial Sequence
  Synthetic
ccgttttttttttttcataggaa

SEQ ID NO: 19881 - DNA, 23 bp, Artificial Sequence
  Synthetic
ccgttttttttttttatcatcaa

SEQ ID NO: 19882 - DNA, 23 bp, Artificial Sequence
  Synthetic
ccgttttttttttttccataggg

SEQ ID NO: 19883 - DNA, 23 bp, Artificial Sequence
  Synthetic
ccgttttttttttttgctacagt

SEQ ID NO: 19884 - DNA, 23 bp, Artificial Sequence
  Synthetic
ccgttttttttttttgtacatca

SEQ ID NO: 19885 - DNA, 23 bp, Artificial Sequence
  Synthetic
ccgttttttttttttgggattcc

SEQ ID NO: 19886 - DNA, 23 bp, Artificial Sequence
  Synthetic
ccgttttttttttttagaagcat

SEQ ID NO: 19887 - DNA, 23 bp, Artificial Sequence
  Synthetic
ccgttttttttttttaaggcaac

SEQ ID NO: 19888 - DNA, 23 bp, Artificial Sequence
  Synthetic
ccgttttttttttttcaaaccat

SEQ ID NO: 19889 - DNA, 23 bp, Artificial Sequence
  Synthetic
ccgttttttttttttaaccatga

SEQ ID NO: 19890 - DNA, 23 bp, Artificial Sequence
  Synthetic
ccgttttttttttttccaatatt

SEQ ID NO: 19891 - DNA, 23 bp, Artificial Sequence
  Synthetic
ccgttttttttttttaagtgcct

SEQ ID NO: 19892 - DNA, 23 bp, Artificial Sequence
  Synthetic
ccgttttttttttttacctgcac

SEQ ID NO: 19893 - DNA, 23 bp, Artificial Sequence
  Synthetic
ccgttttttttttttgcactaga

SEQ ID NO: 19894 - DNA, 23 bp, Artificial Sequence
  Synthetic
ccgttttttttttttcaccgaca

SEQ ID NO: 19895 - DNA, 23 bp, Artificial Sequence
  Synthetic
ccgttttttttttttacaatcaa

SEQ ID NO: 19896 - DNA, 23 bp, Artificial Sequence
  Synthetic
ccgttttttttttttcccaccga

SEQ ID NO: 19897 - DNA, 23 bp, Artificial Sequence
  Synthetic
ccgttttttttttttcaccgaca

SEQ ID NO: 19898 - DNA, 23 bp, Artificial Sequence
  Synthetic
ccgttttttttttttgtgaattc

SEQ ID NO: 19899 - DNA, 23 bp, Artificial Sequence
  Synthetic
ccgttttttttttttccttatca

SEQ ID NO: 19900 - DNA, 23 bp, Artificial Sequence
  Synthetic
ccgttttttttttttgcccaaaa

SEQ ID NO: 19901 - DNA, 23 bp, Artificial Sequence
  Synthetic
ccgttttttttttttcctccacc

SEQ ID NO: 19902 - DNA, 23 bp, Artificial Sequence
  Synthetic
ccgttttttttttttctaatata

SEQ ID NO: 19903 - DNA, 23 bp, Artificial Sequence
  Synthetic
ccgttttttttttttacatggag

SEQ ID NO: 19904 - DNA, 23 bp, Artificial Sequence
  Synthetic
ccgttttttttttttcaacaaca

SEQ ID NO: 19905 - DNA, 23 bp, Artificial Sequence
  Synthetic
ccgttttttttttttgggtggag

SEQ ID NO: 19906 - DNA, 23 bp, Artificial Sequence
  Synthetic
ccgttttttttttttatctcccc

SEQ ID NO: 19907 - DNA, 23 bp, Artificial Sequence
  Synthetic
ccgttttttttttttacaggtag

SEQ ID NO: 19908 - DNA, 23 bp, Artificial Sequence
  Synthetic
ccgttttttttttttgttttgca

SEQ ID NO: 19909 - DNA, 23 bp, Artificial Sequence
  Synthetic
ccgttttttttttttgttttgca

SEQ ID NO: 19910 - DNA, 23 bp, Artificial Sequence
  Synthetic
ccgttttttttttttctgcacta

SEQ ID NO: 19911 - DNA, 23 bp, Artificial Sequence
  Synthetic
ccgttttttttttttgcatagga

SEQ ID NO: 19912 - DNA, 23 bp, Artificial Sequence
  Synthetic
ccgttttttttttttgactccgg

SEQ ID NO: 19913 - DNA, 23 bp, Artificial Sequence
  Synthetic
ccgttttttttttttacatcagt

SEQ ID NO: 19914 - DNA, 23 bp, Artificial Sequence
  Synthetic
ccgttttttttttttcctgtctg

SEQ ID NO: 19915 - DNA, 23 bp, Artificial Sequence
  Synthetic
ccgttttttttttttgtcaattc

SEQ ID NO: 19916 - DNA, 23 bp, Artificial Sequence
  Synthetic
ccgttttttttttttcagttgcc

SEQ ID NO: 19917 - DNA, 23 bp, Artificial Sequence
  Synthetic
ccgttttttttttttatggttag

SEQ ID NO: 19918 - DNA, 23 bp, Artificial Sequence
  Synthetic
ccgttttttttttttagttcttc

SEQ ID NO: 19919 - DNA, 23 bp, Artificial Sequence
  Synthetic
ccgttttttttttttagtgtcag

SEQ ID NO: 19920 - DNA, 23 bp, Artificial Sequence
  Synthetic
ccgttttttttttttggtatttg

SEQ ID NO: 19921 - DNA, 23 bp, Artificial Sequence
  Synthetic
ccgttttttttttttacggaacc

SEQ ID NO: 19922 - DNA, 23 bp, Artificial Sequence
  Synthetic
ccgttttttttttttaaatccct

SEQ ID NO: 19923 - DNA, 23 bp, Artificial Sequence
  Synthetic
ccgttttttttttttgtaatccc

SEQ ID NO: 19924 - DNA, 23 bp, Artificial Sequence
  Synthetic
ccgttttttttttttcctgctga

SEQ ID NO: 19925 - DNA, 23 bp, Artificial Sequence
  Synthetic
ccgttttttttttttgaccgaga

SEQ ID NO: 19926 - DNA, 23 bp, Artificial Sequence
  Synthetic
ccgttttttttttttcctatcct

SEQ ID NO: 19927 - DNA, 23 bp, Artificial Sequence
  Synthetic
ccgttttttttttttcggaactt

SEQ ID NO: 19928 - DNA, 23 bp, Artificial Sequence
  Synthetic
ccgttttttttttttaatagact

SEQ ID NO: 19929 - DNA, 23 bp, Artificial Sequence
  Synthetic
ccgttttttttttttccgatttc

SEQ ID NO: 19930 - DNA, 23 bp, Artificial Sequence
  Synthetic
ccgttttttttttttgatttcaa

SEQ ID NO: 19931 - DNA, 23 bp, Artificial Sequence
  Synthetic
ccgttttttttttttgcaaacat

SEQ ID NO: 19932 - DNA, 23 bp, Artificial Sequence
  Synthetic
ccgttttttttttttcagtcgag

SEQ ID NO: 19933 - DNA, 23 bp, Artificial Sequence
  Synthetic
ccgttttttttttttgagtgtag

SEQ ID NO: 19934 - DNA, 23 bp, Artificial Sequence
  Synthetic
ccgttttttttttttgagagtgt

SEQ ID NO: 19935 - DNA, 23 bp, Artificial Sequence
  Synthetic
ccgttttttttttttcagtcggg

SEQ ID NO: 19936 - DNA, 23 bp, Artificial Sequence
  Synthetic
ccgttttttttttttgctatgcc

SEQ ID NO: 19937 - DNA, 23 bp, Artificial Sequence
  Synthetic
ccgttttttttttttaacttagt

SEQ ID NO: 19938 - DNA, 23 bp, Artificial Sequence
  Synthetic
ccgttttttttttttatgcaact

SEQ ID NO: 19939 - DNA, 23 bp, Artificial Sequence
  Synthetic
ccgttttttttttttaaccagct

SEQ ID NO: 19940 - DNA, 23 bp, Artificial Sequence
  Synthetic
ccgttttttttttttcaaaatca

SEQ ID NO: 19941 - DNA, 23 bp, Artificial Sequence
  Synthetic
ccgttttttttttttacagctag

SEQ ID NO: 19942 - DNA, 23 bp, Artificial Sequence
  Synthetic
ccgttttttttttttaggccggg

SEQ ID NO: 19943 - DNA, 23 bp, Artificial Sequence
  Synthetic
ccgttttttttttttcctgcacg

SEQ ID NO: 19944 - DNA, 23 bp, Artificial Sequence
  Synthetic
ccgttttttttttttcaataaat

SEQ ID NO: 19945 - DNA, 23 bp, Artificial Sequence
  Synthetic
ccgttttttttttttaaaaatgt

SEQ ID NO: 19946 - DNA, 23 bp, Artificial Sequence
  Synthetic
ccgttttttttttttcaatacaa

SEQ ID NO: 19947 - DNA, 23 bp, Artificial Sequence
  Synthetic
ccgttttttttttttcaagatcg

SEQ ID NO: 19948 - DNA, 23 bp, Artificial Sequence
  Synthetic
ccgttttttttttttccccgggg

SEQ ID NO: 19949 - DNA, 23 bp, Artificial Sequence
  Synthetic
ccgttttttttttttcaggtcac

SEQ ID NO: 19950 - DNA, 23 bp, Artificial Sequence
  Synthetic
ccgttttttttttttccgtatcc

SEQ ID NO: 19951 - DNA, 23 bp, Artificial Sequence
  Synthetic
ccgttttttttttttgccagtcc

SEQ ID NO: 19952 - DNA, 23 bp, Artificial Sequence
  Synthetic
ccgttttttttttttcactgtgc

SEQ ID NO: 19953 - DNA, 23 bp, Artificial Sequence
  Synthetic
ccgttttttttttttctggacac

SEQ ID NO: 19954 - DNA, 23 bp, Artificial Sequence
  Synthetic
ccgttttttttttttgttcagcc

SEQ ID NO: 19955 - DNA, 23 bp, Artificial Sequence
  Synthetic
ccgttttttttttttaagcgcac

SEQ ID NO: 19956 - DNA, 23 bp, Artificial Sequence
  Synthetic
ccgttttttttttttaccacacc

SEQ ID NO: 19957 - DNA, 23 bp, Artificial Sequence
  Synthetic
ccgttttttttttttaacaggcc

SEQ ID NO: 19958 - DNA, 23 bp, Artificial Sequence
  Synthetic
ccgttttttttttttaatgaaga

SEQ ID NO: 19959 - DNA, 23 bp, Artificial Sequence
  Synthetic
ccgttttttttttttaaattccc

SEQ ID NO: 19960 - DNA, 23 bp, Artificial Sequence
  Synthetic
ccgttttttttttttcagtagag

SEQ ID NO: 19961 - DNA, 23 bp, Artificial Sequence
  Synthetic
ccgttttttttttttacctagtg

SEQ ID NO: 19962 - DNA, 23 bp, Artificial Sequence
  Synthetic
ccgttttttttttttcaccgcac

SEQ ID NO: 19963 - DNA, 23 bp, Artificial Sequence
  Synthetic
ccgttttttttttttacctagtg

SEQ ID NO: 19964 - DNA, 23 bp, Artificial Sequence
  Synthetic
ccgttttttttttttcacatcac

SEQ ID NO: 19965 - DNA, 23 bp, Artificial Sequence
  Synthetic
ccgttttttttttttcatagtgg

SEQ ID NO: 19966 - DNA, 23 bp, Artificial Sequence
  Synthetic
ccgttttttttttttcagcacgt

SEQ ID NO: 19967 - DNA, 23 bp, Artificial Sequence
  Synthetic
ccgttttttttttttgtaagccg

SEQ ID NO: 19968 - DNA, 23 bp, Artificial Sequence
  Synthetic
ccgttttttttttttatgggcag

SEQ ID NO: 19969 - DNA, 23 bp, Artificial Sequence
  Synthetic
ccgttttttttttttaagggggg

SEQ ID NO: 19970 - DNA, 23 bp, Artificial Sequence
  Synthetic
ccgttttttttttttctatacaa

SEQ ID NO: 19971 - DNA, 23 bp, Artificial Sequence
  Synthetic
ccgttttttttttttccacacaa

SEQ ID NO: 19972 - DNA, 23 bp, Artificial Sequence
  Synthetic
ccgttttttttttttccatacaa

SEQ ID NO: 19973 - DNA, 23 bp, Artificial Sequence
  Synthetic
ccgttttttttttttatgcaacc

SEQ ID NO: 19974 - DNA, 23 bp, Artificial Sequence
  Synthetic
ccgttttttttttttaaaggcag

SEQ ID NO: 19975 - DNA, 23 bp, Artificial Sequence
  Synthetic
ccgttttttttttttatacaacc

SEQ ID NO: 19976 - DNA, 23 bp, Artificial Sequence
  Synthetic
ccgttttttttttttctatacaa

SEQ ID NO: 19977 - DNA, 23 bp, Artificial Sequence
  Synthetic
ccgttttttttttttagcacaaa

SEQ ID NO: 19978 - DNA, 23 bp, Artificial Sequence
  Synthetic
ccgttttttttttttacacttct

SEQ ID NO: 19979 - DNA, 23 bp, Artificial Sequence
  Synthetic
ccgttttttttttttgtacataa

SEQ ID NO: 19980 - DNA, 23 bp, Artificial Sequence
  Synthetic
ccgttttttttttttcaagttcg

SEQ ID NO: 19981 - DNA, 23 bp, Artificial Sequence
  Synthetic
ccgttttttttttttagttatca

SEQ ID NO: 19982 - DNA, 23 bp, Artificial Sequence
  Synthetic
ccgttttttttttttagctatca

SEQ ID NO: 19983 - DNA, 23 bp, Artificial Sequence
  Synthetic
ccgttttttttttttagccctgt

SEQ ID NO: 19984 - DNA, 23 bp, Artificial Sequence
  Synthetic
ccgttttttttttttgcactgtc

SEQ ID NO: 19985 - DNA, 23 bp, Artificial Sequence
  Synthetic
ccgttttttttttttagccctgt

SEQ ID NO: 19986 - DNA, 23 bp, Artificial Sequence
  Synthetic
ccgttttttttttttcaaattcg

SEQ ID NO: 19987 - DNA, 23 bp, Artificial Sequence
  Synthetic
ccgttttttttttttacaaattc

SEQ ID NO: 19988 - DNA, 23 bp, Artificial Sequence
  Synthetic
ccgttttttttttttaaacacca

SEQ ID NO: 19989 - DNA, 23 bp, Artificial Sequence
  Synthetic
ccgttttttttttttcattcacc

SEQ ID NO: 19990 - DNA, 23 bp, Artificial Sequence
  Synthetic
ccgttttttttttttcaggttaa

SEQ ID NO: 19991 - DNA, 23 bp, Artificial Sequence
  Synthetic
ccgttttttttttttcaagttag

SEQ ID NO: 19992 - DNA, 23 bp, Artificial Sequence
  Synthetic
ccgttttttttttttattattac

SEQ ID NO: 19993 - DNA, 23 bp, Artificial Sequence
  Synthetic
ccgttttttttttttcgtaccaa

SEQ ID NO: 19994 - DNA, 23 bp, Artificial Sequence
  Synthetic
ccgttttttttttttccaagctc

SEQ ID NO: 19995 - DNA, 23 bp, Artificial Sequence
  Synthetic
ccgttttttttttttaagagacc

SEQ ID NO: 19996 - DNA, 23 bp, Artificial Sequence
  Synthetic
ccgttttttttttttaagagacc

SEQ ID NO: 19997 - DNA, 23 bp, Artificial Sequence
  Synthetic
ccgttttttttttttcaagccca

SEQ ID NO: 19998 - DNA, 23 bp, Artificial Sequence
  Synthetic
ccgttttttttttttctttttgg

SEQ ID NO: 19999 - DNA, 23 bp, Artificial Sequence
  Synthetic
ccgttttttttttttccctttta

SEQ ID NO: 20000 - DNA, 23 bp, Artificial Sequence
  Synthetic
ccgttttttttttttccctttca

SEQ ID NO: 20001 - DNA, 23 bp, Artificial Sequence
  Synthetic
ccgttttttttttttaccatggc

SEQ ID NO: 20002 - DNA, 23 bp, Artificial Sequence
  Synthetic
ccgttttttttttttagctggtt

SEQ ID NO: 20003 - DNA, 23 bp, Artificial Sequence
  Synthetic
ccgttttttttttttctggttga

SEQ ID NO: 20004 - DNA, 23 bp, Artificial Sequence
  Synthetic
ccgttttttttttttctctggtc

SEQ ID NO: 20005 - DNA, 23 bp, Artificial Sequence
  Synthetic
ccgttttttttttttcataggaa

SEQ ID NO: 20006 - DNA, 23 bp, Artificial Sequence
  Synthetic
ccgttttttttttttcataggaa

SEQ ID NO: 20007 - DNA, 23 bp, Artificial Sequence
  Synthetic
ccgttttttttttttatcatcaa

SEQ ID NO: 20008 - DNA, 23 bp, Artificial Sequence
  Synthetic
ccgttttttttttttcgcgtatt

SEQ ID NO: 20009 - DNA, 23 bp, Artificial Sequence
  Synthetic
ccgttttttttttttcacaacac

SEQ ID NO: 20010 - DNA, 23 bp, Artificial Sequence
  Synthetic
ccgttttttttttttacacgtgc

SEQ ID NO: 20011 - DNA, 23 bp, Artificial Sequence
  Synthetic
ccgttttttttttttccataggg

SEQ ID NO: 20012 - DNA, 23 bp, Artificial Sequence
  Synthetic
ccgttttttttttttcgtggttc

SEQ ID NO: 20013 - DNA, 23 bp, Artificial Sequence
  Synthetic
ccgttttttttttttatctttac

SEQ ID NO: 20014 - DNA, 23 bp, Artificial Sequence
  Synthetic
ccgttttttttttttataaagta

SEQ ID NO: 20015 - DNA, 23 bp, Artificial Sequence
  Synthetic
ccgttttttttttttgtgctttc

SEQ ID NO: 20016 - DNA, 23 bp, Artificial Sequence
  Synthetic
ccgttttttttttttgctacagt

SEQ ID NO: 20017 - DNA, 23 bp, Artificial Sequence
  Synthetic
ccgttttttttttttgtacatca

SEQ ID NO: 20018 - DNA, 23 bp, Artificial Sequence
  Synthetic
ccgttttttttttttgggattcc

SEQ ID NO: 20019 - DNA, 23 bp, Artificial Sequence
  Synthetic
ccgttttttttttttcccatgga

SEQ ID NO: 20020 - DNA, 23 bp, Artificial Sequence
  Synthetic
ccgttttttttttttaaagttct

SEQ ID NO: 20021 - DNA, 23 bp, Artificial Sequence
  Synthetic
ccgttttttttttttctggtaca

SEQ ID NO: 20022 - DNA, 23 bp, Artificial Sequence
  Synthetic
ccgttttttttttttcaaggagc

SEQ ID NO: 20023 - DNA, 23 bp, Artificial Sequence
  Synthetic
ccgttttttttttttagactgtg

SEQ ID NO: 20024 - DNA, 23 bp, Artificial Sequence
  Synthetic
ccgttttttttttttcaagttct

SEQ ID NO: 20025 - DNA, 23 bp, Artificial Sequence
  Synthetic
ccgttttttttttttcttttgtg

SEQ ID NO: 20026 - DNA, 23 bp, Artificial Sequence
  Synthetic
ccgttttttttttttaaggcaac

SEQ ID NO: 20027 - DNA, 23 bp, Artificial Sequence
  Synthetic
ccgttttttttttttaaccatga

SEQ ID NO: 20028 - DNA, 23 bp, Artificial Sequence
  Synthetic
ccgttttttttttttccaatatt

SEQ ID NO: 20029 - DNA, 23 bp, Artificial Sequence
  Synthetic
ccgttttttttttttacctgcac

SEQ ID NO: 20030 - DNA, 23 bp, Artificial Sequence
  Synthetic
ccgttttttttttttgcactaga

SEQ ID NO: 20031 - DNA, 23 bp, Artificial Sequence
  Synthetic
ccgttttttttttttcaccgaca

SEQ ID NO: 20032 - DNA, 23 bp, Artificial Sequence
  Synthetic
ccgttttttttttttacaatcaa

SEQ ID NO: 20033 - DNA, 23 bp, Artificial Sequence
  Synthetic
ccgttttttttttttcaccgaca

SEQ ID NO: 20034 - DNA, 23 bp, Artificial Sequence
  Synthetic
ccgttttttttttttcaccgaca

SEQ ID NO: 20035 - DNA, 23 bp, Artificial Sequence
  Synthetic
ccgttttttttttttgtgaattc

SEQ ID NO: 20036 - DNA, 23 bp, Artificial Sequence
  Synthetic
ccgttttttttttttccttatca

SEQ ID NO: 20037 - DNA, 23 bp, Artificial Sequence
  Synthetic
ccgttttttttttttactgcctt

SEQ ID NO: 20038 - DNA, 23 bp, Artificial Sequence
  Synthetic
ccgttttttttttttgcccaaaa

SEQ ID NO: 20039 - DNA, 23 bp, Artificial Sequence
  Synthetic
ccgttttttttttttgctgcaac

SEQ ID NO: 20040 - DNA, 23 bp, Artificial Sequence
  Synthetic
ccgttttttttttttgatatcag

SEQ ID NO: 20041 - DNA, 23 bp, Artificial Sequence
  Synthetic
ccgttttttttttttctaatata

SEQ ID NO: 20042 - DNA, 23 bp, Artificial Sequence
  Synthetic
ccgttttttttttttctgctttt

SEQ ID NO: 20043 - DNA, 23 bp, Artificial Sequence
  Synthetic
ccgttttttttttttctgtcaat

SEQ ID NO: 20044 - DNA, 23 bp, Artificial Sequence
  Synthetic
ccgttttttttttttggactttg

SEQ ID NO: 20045 - DNA, 23 bp, Artificial Sequence
  Synthetic
ccgttttttttttttacatggag

SEQ ID NO: 20046 - DNA, 23 bp, Artificial Sequence
  Synthetic
ccgttttttttttttcaatattt

SEQ ID NO: 20047 - DNA, 23 bp, Artificial Sequence
  Synthetic
ccgttttttttttttaacaacat

SEQ ID NO: 20048 - DNA, 23 bp, Artificial Sequence
  Synthetic
ccgttttttttttttaacaacag

SEQ ID NO: 20049 - DNA, 23 bp, Artificial Sequence
  Synthetic
ccgttttttttttttacaggtag

SEQ ID NO: 20050 - DNA, 23 bp, Artificial Sequence
  Synthetic
ccgttttttttttttgttttgca

SEQ ID NO: 20051 - DNA, 23 bp, Artificial Sequence
  Synthetic
ccgttttttttttttgttttgca

SEQ ID NO: 20052 - DNA, 23 bp, Artificial Sequence
  Synthetic
ccgttttttttttttatcgttac

SEQ ID NO: 20053 - DNA, 23 bp, Artificial Sequence
  Synthetic
ccgttttttttttttatcattac

SEQ ID NO: 20054 - DNA, 23 bp, Artificial Sequence
  Synthetic
ccgttttttttttttatcattac

SEQ ID NO: 20055 - DNA, 23 bp, Artificial Sequence
  Synthetic
ccgttttttttttttgtggtcct

SEQ ID NO: 20056 - DNA, 23 bp, Artificial Sequence
  Synthetic
ccgttttttttttttgcatagga

SEQ ID NO: 20057 - DNA, 23 bp, Artificial Sequence
  Synthetic
ccgttttttttttttgactccgg

SEQ ID NO: 20058 - DNA, 23 bp, Artificial Sequence
  Synthetic
ccgttttttttttttacacactt

SEQ ID NO: 20059 - DNA, 23 bp, Artificial Sequence
  Synthetic
ccgttttttttttttgggaggag

SEQ ID NO: 20060 - DNA, 23 bp, Artificial Sequence
  Synthetic
ccgttttttttttttaagctttt

SEQ ID NO: 20061 - DNA, 23 bp, Artificial Sequence
  Synthetic
ccgttttttttttttcctgcact

SEQ ID NO: 20062 - DNA, 23 bp, Artificial Sequence
  Synthetic
ccgttttttttttttagtgctcg

SEQ ID NO: 20063 - DNA, 23 bp, Artificial Sequence
  Synthetic
ccgttttttttttttctgcacta

SEQ ID NO: 20064 - DNA, 23 bp, Artificial Sequence
  Synthetic
ccgttttttttttttgaagtgct

SEQ ID NO: 20065 - DNA, 23 bp, Artificial Sequence
  Synthetic
ccgttttttttttttacatcagt

SEQ ID NO: 20066 - DNA, 23 bp, Artificial Sequence
  Synthetic
ccgttttttttttttgccgctgt

SEQ ID NO: 20067 - DNA, 23 bp, Artificial Sequence
  Synthetic
ccgttttttttttttgcaaagga

SEQ ID NO: 20068 - DNA, 23 bp, Artificial Sequence
  Synthetic
ccgttttttttttttccgtgact

SEQ ID NO: 20069 - DNA, 23 bp, Artificial Sequence
  Synthetic
ccgttttttttttttcctgtctg

SEQ ID NO: 20070 - DNA, 23 bp, Artificial Sequence
  Synthetic
ccgttttttttttttgtcaaatc

SEQ ID NO: 20071 - DNA, 23 bp, Artificial Sequence
  Synthetic
ccgttttttttttttcagttgcc

SEQ ID NO: 20072 - DNA, 23 bp, Artificial Sequence
  Synthetic
ccgttttttttttttcagtcagt

SEQ ID NO: 20073 - DNA, 23 bp, Artificial Sequence
  Synthetic
ccgttttttttttttatggttag

SEQ ID NO: 20074 - DNA, 23 bp, Artificial Sequence
  Synthetic
ccgttttttttttttaattgcgt

SEQ ID NO: 20075 - DNA, 23 bp, Artificial Sequence
  Synthetic
ccgttttttttttttagttcttc

SEQ ID NO: 20076 - DNA, 23 bp, Artificial Sequence
  Synthetic
ccgttttttttttttagcttgcc

SEQ ID NO: 20077 - DNA, 23 bp, Artificial Sequence
  Synthetic
ccgttttttttttttaacccagc

SEQ ID NO: 20078 - DNA, 23 bp, Artificial Sequence
  Synthetic
ccgttttttttttttgacccagt

SEQ ID NO: 20079 - DNA, 23 bp, Artificial Sequence
  Synthetic
ccgttttttttttttggtatttg

SEQ ID NO: 20080 - DNA, 23 bp, Artificial Sequence
  Synthetic
ccgttttttttttttacggaacc

SEQ ID NO: 20081 - DNA, 23 bp, Artificial Sequence
  Synthetic
ccgttttttttttttaaatccct

SEQ ID NO: 20082 - DNA, 23 bp, Artificial Sequence
  Synthetic
ccgttttttttttttaatccctg

SEQ ID NO: 20083 - DNA, 23 bp, Artificial Sequence
  Synthetic
ccgttttttttttttcctgctga

SEQ ID NO: 20084 - DNA, 23 bp, Artificial Sequence
  Synthetic
ccgttttttttttttgaccgaga

SEQ ID NO: 20085 - DNA, 23 bp, Artificial Sequence
  Synthetic
ccgttttttttttttctatcctg

SEQ ID NO: 20086 - DNA, 23 bp, Artificial Sequence
  Synthetic
ccgttttttttttttcctatcct

SEQ ID NO: 20087 - DNA, 23 bp, Artificial Sequence
  Synthetic
ccgttttttttttttggaactta

SEQ ID NO: 20088 - DNA, 23 bp, Artificial Sequence
  Synthetic
ccgttttttttttttagaactta

SEQ ID NO: 20089 - DNA, 23 bp, Artificial Sequence
  Synthetic
ccgttttttttttttaatagact

SEQ ID NO: 20090 - DNA, 23 bp, Artificial Sequence
  Synthetic
ccgttttttttttttaaagtgcc

SEQ ID NO: 20091 - DNA, 23 bp, Artificial Sequence
  Synthetic
ccgttttttttttttcacacaaa

SEQ ID NO: 20092 - DNA, 23 bp, Artificial Sequence
  Synthetic
ccgttttttttttttagagggcc

SEQ ID NO: 20093 - DNA, 23 bp, Artificial Sequence
  Synthetic
ccgttttttttttttactcaaaa

SEQ ID NO: 20094 - DNA, 23 bp, Artificial Sequence
  Synthetic
ccgttttttttttttaaagagcc

SEQ ID NO: 20095 - DNA, 23 bp, Artificial Sequence
  Synthetic
ccgttttttttttttaggattga

SEQ ID NO: 20096 - DNA, 23 bp, Artificial Sequence
  Synthetic
ccgttttttttttttgcatacat

SEQ ID NO: 20097 - DNA, 23 bp, Artificial Sequence
  Synthetic
ccgttttttttttttaagaacag

SEQ ID NO: 20098 - DNA, 23 bp, Artificial Sequence
  Synthetic
ccgttttttttttttatgtggga

SEQ ID NO: 20099 - DNA, 23 bp, Artificial Sequence
  Synthetic
ccgttttttttttttccgatttc

SEQ ID NO: 20100 - DNA, 23 bp, Artificial Sequence
  Synthetic
ccgttttttttttttcactgatt

SEQ ID NO: 20101 - DNA, 23 bp, Artificial Sequence
  Synthetic
ccgttttttttttttcgatttca

SEQ ID NO: 20102 - DNA, 23 bp, Artificial Sequence
  Synthetic
ccgttttttttttttacaccagg

SEQ ID NO: 20103 - DNA, 23 bp, Artificial Sequence
  Synthetic
ccgttttttttttttagagagct

SEQ ID NO: 20104 - DNA, 23 bp, Artificial Sequence
  Synthetic
ccgttttttttttttctttgaca

SEQ ID NO: 20105 - DNA, 23 bp, Artificial Sequence
  Synthetic
ccgttttttttttttgcaaacat

SEQ ID NO: 20106 - DNA, 23 bp, Artificial Sequence
  Synthetic
ccgttttttttttttcagtcgag

SEQ ID NO: 20107 - DNA, 23 bp, Artificial Sequence
  Synthetic
ccgttttttttttttctgagtgt

SEQ ID NO: 20108 - DNA, 23 bp, Artificial Sequence
  Synthetic
ccgttttttttttttgagagtgt

SEQ ID NO: 20109 - DNA, 23 bp, Artificial Sequence
  Synthetic
ccgttttttttttttcagtcggg

SEQ ID NO: 20110 - DNA, 23 bp, Artificial Sequence
  Synthetic
ccgttttttttttttagtcaagg

SEQ ID NO: 20111 - DNA, 23 bp, Artificial Sequence
  Synthetic
ccgttttttttttttgctatgcc

SEQ ID NO: 20112 - DNA, 23 bp, Artificial Sequence
  Synthetic
ccgttttttttttttaacttagt

SEQ ID NO: 20113 - DNA, 23 bp, Artificial Sequence
  Synthetic
ccgttttttttttttccctctca

SEQ ID NO: 20114 - DNA, 23 bp, Artificial Sequence
  Synthetic
ccgttttttttttttcagcgctt

SEQ ID NO: 20115 - DNA, 23 bp, Artificial Sequence
  Synthetic
ccgttttttttttttaggtcgac

SEQ ID NO: 20116 - DNA, 23 bp, Artificial Sequence
  Synthetic
ccgttttttttttttagcagcac

SEQ ID NO: 20117 - DNA, 23 bp, Artificial Sequence
  Synthetic
ccgttttttttttttaccaatgc

SEQ ID NO: 20118 - DNA, 23 bp, Artificial Sequence
  Synthetic
ccgttttttttttttacttactg

SEQ ID NO: 20119 - DNA, 23 bp, Artificial Sequence
  Synthetic
ccgttttttttttttggaggaag

SEQ ID NO: 20120 - DNA, 23 bp, Artificial Sequence
  Synthetic
ccgttttttttttttcctcatgc

SEQ ID NO: 20121 - DNA, 23 bp, Artificial Sequence
  Synthetic
ccgttttttttttttggaagggc

SEQ ID NO: 20122 - DNA, 23 bp, Artificial Sequence
  Synthetic
ccgttttttttttttaaaggtta

SEQ ID NO: 20123 - DNA, 23 bp, Artificial Sequence
  Synthetic
ccgttttttttttttatgcaact

SEQ ID NO: 20124 - DNA, 23 bp, Artificial Sequence
  Synthetic
ccgttttttttttttgcaggccc

SEQ ID NO: 20125 - DNA, 23 bp, Artificial Sequence
  Synthetic
ccgttttttttttttggataggc

SEQ ID NO: 20126 - DNA, 23 bp, Artificial Sequence
  Synthetic
ccgttttttttttttaagtaact

SEQ ID NO: 20127 - DNA, 23 bp, Artificial Sequence
  Synthetic
ccgttttttttttttatttttcg

SEQ ID NO: 20128 - DNA, 23 bp, Artificial Sequence
  Synthetic
ccgttttttttttttactagata

SEQ ID NO: 20129 - DNA, 23 bp, Artificial Sequence
  Synthetic
ccgttttttttttttaggcatca

SEQ ID NO: 20130 - DNA, 23 bp, Artificial Sequence
  Synthetic
ccgttttttttttttacaaaatc

SEQ ID NO: 20131 - DNA, 23 bp, Artificial Sequence
  Synthetic
ccgttttttttttttgctcctgg

SEQ ID NO: 20132 - DNA, 23 bp, Artificial Sequence
  Synthetic
ccgttttttttttttctataaag

SEQ ID NO: 20133 - DNA, 23 bp, Artificial Sequence
  Synthetic
ccgttttttttttttgaccgacc

SEQ ID NO: 20134 - DNA, 23 bp, Artificial Sequence
  Synthetic
ccgttttttttttttcgggtgcg

SEQ ID NO: 20135 - DNA, 23 bp, Artificial Sequence
  Synthetic
ccgttttttttttttggcacacg

SEQ ID NO: 20136 - DNA, 23 bp, Artificial Sequence
  Synthetic
ccgttttttttttttggtcaggc

SEQ ID NO: 20137 - DNA, 23 bp, Artificial Sequence
  Synthetic
ccgttttttttttttactggact

SEQ ID NO: 20138 - DNA, 23 bp, Artificial Sequence
  Synthetic
ccgttttttttttttaggcaggc

SEQ ID NO: 20139 - DNA, 23 bp, Artificial Sequence
  Synthetic
ccgttttttttttttgcgaccca

SEQ ID NO: 20140 - DNA, 23 bp, Artificial Sequence
  Synthetic
ccgttttttttttttaggttaag

SEQ ID NO: 20141 - DNA, 23 bp, Artificial Sequence
  Synthetic
ccgttttttttttttcaaccagc

SEQ ID NO: 20142 - DNA, 23 bp, Artificial Sequence
  Synthetic
ccgttttttttttttatcagcta

SEQ ID NO: 20143 - DNA, 23 bp, Artificial Sequence
  Synthetic
ccgttttttttttttaatcagct

SEQ ID NO: 20144 - DNA, 23 bp, Artificial Sequence
  Synthetic
ccgttttttttttttaaagtgta

SEQ ID NO: 20145 - DNA, 23 bp, Artificial Sequence
  Synthetic
ccgttttttttttttggctcaaa

SEQ ID NO: 20146 - DNA, 23 bp, Artificial Sequence
  Synthetic
ccgttttttttttttatgcaacc

SEQ ID NO: 20147 - DNA, 23 bp, Artificial Sequence
  Synthetic
ccgttttttttttttcccctgga

SEQ ID NO: 20148 - DNA, 23 bp, Artificial Sequence
  Synthetic
ccgttttttttttttagatggat

SEQ ID NO: 20149 - DNA, 23 bp, Artificial Sequence
  Synthetic
ccgttttttttttttattgcatc

SEQ ID NO: 20150 - DNA, 23 bp, Artificial Sequence
  Synthetic
ccgttttttttttttaggatttt

SEQ ID NO: 20151 - DNA, 23 bp, Artificial Sequence
  Synthetic
ccgttttttttttttgatcaacc

SEQ ID NO: 20152 - DNA, 23 bp, Artificial Sequence
  Synthetic
ccgttttttttttttaatataac

SEQ ID NO: 20153 - DNA, 23 bp, Artificial Sequence
  Synthetic
ccgttttttttttttccaggttc

SEQ ID NO: 20154 - DNA, 23 bp, Artificial Sequence
  Synthetic
ccgttttttttttttcttagcag

SEQ ID NO: 20155 - DNA, 23 bp, Artificial Sequence
  Synthetic
ccgttttttttttttggattttc

SEQ ID NO: 20156 - DNA, 23 bp, Artificial Sequence
  Synthetic
ccgttttttttttttatagaagg

SEQ ID NO: 20157 - DNA, 23 bp, Artificial Sequence
  Synthetic
ccgttttttttttttggatgttc

SEQ ID NO: 20158 - DNA, 23 bp, Artificial Sequence
  Synthetic
ccgttttttttttttccatagaa

SEQ ID NO: 20159 - DNA, 23 bp, Artificial Sequence
  Synthetic
ccgttttttttttttgaaatttc

SEQ ID NO: 20160 - DNA, 23 bp, Artificial Sequence
  Synthetic
ccgttttttttttttaaaagttg

SEQ ID NO: 20161 - DNA, 23 bp, Artificial Sequence
  Synthetic
ccgttttttttttttacaggacc

SEQ ID NO: 20162 - DNA, 23 bp, Artificial Sequence
  Synthetic
ccgttttttttttttgttccata

SEQ ID NO: 20163 - DNA, 23 bp, Artificial Sequence
  Synthetic
ccgttttttttttttgagcttgc

SEQ ID NO: 20164 - DNA, 23 bp, Artificial Sequence
  Synthetic
ccgttttttttttttatccacca

SEQ ID NO: 20165 - DNA, 23 bp, Artificial Sequence
  Synthetic
ccgttttttttttttgtgttgtc

SEQ ID NO: 20166 - DNA, 23 bp, Artificial Sequence
  Synthetic
ccgttttttttttttccacagtc

SEQ ID NO: 20167 - DNA, 23 bp, Artificial Sequence
  Synthetic
ccgttttttttttttggttcacc

SEQ ID NO: 20168 - DNA, 23 bp, Artificial Sequence
  Synthetic
ccgttttttttttttaagttgct

SEQ ID NO: 20169 - DNA, 23 bp, Artificial Sequence
  Synthetic
ccgttttttttttttggctagtg

SEQ ID NO: 20170 - DNA, 23 bp, Artificial Sequence
  Synthetic
ccgttttttttttttacaaacat

SEQ ID NO: 20171 - DNA, 23 bp, Artificial Sequence
  Synthetic
ccgttttttttttttcttctgac

SEQ ID NO: 20172 - DNA, 23 bp, Artificial Sequence
  Synthetic
ccgttttttttttttaaaacatg

SEQ ID NO: 20173 - DNA, 23 bp, Artificial Sequence
  Synthetic
ccgttttttttttttggcattac

SEQ ID NO: 20174 - DNA, 23 bp, Artificial Sequence
  Synthetic
ccgttttttttttttatgacggc

SEQ ID NO: 20175 - DNA, 23 bp, Artificial Sequence
  Synthetic
ccgttttttttttttaccgagga

SEQ ID NO: 20176 - DNA, 23 bp, Artificial Sequence
  Synthetic
ccgttttttttttttggacatcc

SEQ ID NO: 20177 - DNA, 23 bp, Artificial Sequence
  Synthetic
ccgttttttttttttcagctaac

SEQ ID NO: 20178 - DNA, 23 bp, Artificial Sequence
  Synthetic
ccgttttttttttttaggaacac

SEQ ID NO: 20179 - DNA, 23 bp, Artificial Sequence
  Synthetic
ccgttttttttttttctcagtaa

SEQ ID NO: 20180 - DNA, 23 bp, Artificial Sequence
  Synthetic
ccgttttttttttttaagacggg

SEQ ID NO: 20181 - DNA, 23 bp, Artificial Sequence
  Synthetic
ccgttttttttttttattcatca

SEQ ID NO: 20182 - DNA, 23 bp, Artificial Sequence
  Synthetic
ccgttttttttttttggatgacc

SEQ ID NO: 20183 - DNA, 23 bp, Artificial Sequence
  Synthetic
ccgttttttttttttgccatata

SEQ ID NO: 20184 - DNA, 23 bp, Artificial Sequence
  Synthetic
ccgttttttttttttgcacacag

SEQ ID NO: 20185 - DNA, 23 bp, Artificial Sequence
  Synthetic
ccgttttttttttttgtttcccg

SEQ ID NO: 20186 - DNA, 23 bp, Artificial Sequence
  Synthetic
ccgttttttttttttaaaccaca

SEQ ID NO: 20187 - DNA, 23 bp, Artificial Sequence
  Synthetic
ccgttttttttttttacatcact

SEQ ID NO: 20188 - DNA, 23 bp, Artificial Sequence
  Synthetic
ccgttttttttttttcccaggga

SEQ ID NO: 20189 - DNA, 23 bp, Artificial Sequence
  Synthetic
ccgttttttttttttgtactgtt

SEQ ID NO: 20190 - DNA, 23 bp, Artificial Sequence
  Synthetic
ccgttttttttttttaaaccagc

SEQ ID NO: 20191 - DNA, 23 bp, Artificial Sequence
  Synthetic
ccgttttttttttttacaccaag

SEQ ID NO: 20192 - DNA, 23 bp, Artificial Sequence
  Synthetic
ccgttttttttttttaggatcga

SEQ ID NO: 20193 - DNA, 23 bp, Artificial Sequence
  Synthetic
ccgttttttttttttaccaacat

SEQ ID NO: 20194 - DNA, 23 bp, Artificial Sequence
  Synthetic
ccgttttttttttttgttatcaa

SEQ ID NO: 20195 - DNA, 23 bp, Artificial Sequence
  Synthetic
ccgttttttttttttgacatgat

SEQ ID NO: 20196 - DNA, 23 bp, Artificial Sequence
  Synthetic
ccgttttttttttttaagtgcac

SEQ ID NO: 20197 - DNA, 23 bp, Artificial Sequence
  Synthetic
ccgttttttttttttgctgggga

SEQ ID NO: 20198 - DNA, 23 bp, Artificial Sequence
  Synthetic
ccgttttttttttttcaaaatca

SEQ ID NO: 20199 - DNA, 23 bp, Artificial Sequence
  Synthetic
ccgttttttttttttgcagactg

SEQ ID NO: 20200 - DNA, 23 bp, Artificial Sequence
  Synthetic
ccgttttttttttttcaaaatca

SEQ ID NO: 20201 - DNA, 23 bp, Artificial Sequence
  Synthetic
ccgttttttttttttacagctag

SEQ ID NO: 20202 - DNA, 23 bp, Artificial Sequence
  Synthetic
ccgttttttttttttggccggga

SEQ ID NO: 20203 - DNA, 23 bp, Artificial Sequence
  Synthetic
ccgttttttttttttcctgcacg

SEQ ID NO: 20204 - DNA, 23 bp, Artificial Sequence
  Synthetic
ccgttttttttttttcaaaaatg

SEQ ID NO: 20205 - DNA, 23 bp, Artificial Sequence
  Synthetic
ccgttttttttttttcaatacaa

SEQ ID NO: 20206 - DNA, 23 bp, Artificial Sequence
  Synthetic
ccgttttttttttttcaagatcg

SEQ ID NO: 20207 - DNA, 23 bp, Artificial Sequence
  Synthetic
ccgttttttttttttcaaggtcg

SEQ ID NO: 20208 - DNA, 23 bp, Artificial Sequence
  Synthetic
ccgttttttttttttctcactct

SEQ ID NO: 20209 - DNA, 23 bp, Artificial Sequence
  Synthetic
ccgttttttttttttctcactct

SEQ ID NO: 20210 - DNA, 23 bp, Artificial Sequence
  Synthetic
ccgttttttttttttctcactct

SEQ ID NO: 20211 - DNA, 23 bp, Artificial Sequence
  Synthetic
ccgttttttttttttctctctct

SEQ ID NO: 20212 - DNA, 23 bp, Artificial Sequence
  Synthetic
ccgttttttttttttctcgctct

SEQ ID NO: 20213 - DNA, 23 bp, Artificial Sequence
  Synthetic
ccgttttttttttttgagctccc

SEQ ID NO: 20214 - DNA, 23 bp, Artificial Sequence
  Synthetic
ccgttttttttttttgagctccc

SEQ ID NO: 20215 - DNA, 23 bp, Artificial Sequence
  Synthetic
ccgttttttttttttcatacagg

SEQ ID NO: 20216 - DNA, 23 bp, Artificial Sequence
  Synthetic
ccgttttttttttttcatacagg

SEQ ID NO: 20217 - DNA, 23 bp, Artificial Sequence
  Synthetic
ccgttttttttttttcatacagg

SEQ ID NO: 20218 - DNA, 23 bp, Artificial Sequence
  Synthetic
ccgttttttttttttcatacagg

SEQ ID NO: 20219 - DNA, 23 bp, Artificial Sequence
  Synthetic
ccgttttttttttttcatacagg

SEQ ID NO: 20220 - DNA, 23 bp, Artificial Sequence
  Synthetic
ccgttttttttttttacgtgccc

SEQ ID NO: 20221 - DNA, 23 bp, Artificial Sequence
  Synthetic
ccgttttttttttttcacgtgcc

SEQ ID NO: 20222 - DNA, 23 bp, Artificial Sequence
  Synthetic
ccgttttttttttttacgtgtcc

SEQ ID NO: 20223 - DNA, 23 bp, Artificial Sequence
  Synthetic
ccgttttttttttttgaatgaag

SEQ ID NO: 20224 - DNA, 23 bp, Artificial Sequence
  Synthetic
ccgttttttttttttgaatgaag

SEQ ID NO: 20225 - DNA, 23 bp, Artificial Sequence
  Synthetic
ccgttttttttttttgaatgaag

SEQ ID NO: 20226 - DNA, 23 bp, Artificial Sequence
  Synthetic
ccgttttttttttttgaatgaag

SEQ ID NO: 20227 - DNA, 23 bp, Artificial Sequence
  Synthetic
ccgttttttttttttggattgaa

SEQ ID NO: 20228 - DNA, 23 bp, Artificial Sequence
  Synthetic
ccgttttttttttttggaatgaa

SEQ ID NO: 20229 - DNA, 23 bp, Artificial Sequence
  Synthetic
ccgttttttttttttggattgaa

SEQ ID NO: 20230 - DNA, 23 bp, Artificial Sequence
  Synthetic
ccgttttttttttttatcatgct

SEQ ID NO: 20231 - DNA, 23 bp, Artificial Sequence
  Synthetic
ccgttttttttttttatcatgct

SEQ ID NO: 20232 - DNA, 23 bp, Artificial Sequence
  Synthetic
ccgttttttttttttgatcatgc

SEQ ID NO: 20233 - DNA, 23 bp, Artificial Sequence
  Synthetic
ccgttttttttttttgatcatgc

SEQ ID NO: 20234 - DNA, 23 bp, Artificial Sequence
  Synthetic
ccgttttttttttttgatcatgc

SEQ ID NO: 20235 - DNA, 23 bp, Artificial Sequence
  Synthetic
ccgttttttttttttgatcatgc

SEQ ID NO: 20236 - DNA, 23 bp, Artificial Sequence
  Synthetic
ccgttttttttttttgatcatgc

SEQ ID NO: 20237 - DNA, 23 bp, Artificial Sequence
  Synthetic
ccgttttttttttttccgatctg

SEQ ID NO: 20238 - DNA, 23 bp, Artificial Sequence
  Synthetic
ccgttttttttttttgcaagtca

SEQ ID NO: 20239 - DNA, 23 bp, Artificial Sequence
  Synthetic
ccgttttttttttttggcaagtc

SEQ ID NO: 20240 - DNA, 23 bp, Artificial Sequence
  Synthetic
ccgttttttttttttgcaagtca

SEQ ID NO: 20241 - DNA, 23 bp, Artificial Sequence
  Synthetic
ccgttttttttttttgcaagtca

SEQ ID NO: 20242 - DNA, 23 bp, Artificial Sequence
  Synthetic
ccgttttttttttttggcaagtc

SEQ ID NO: 20243 - DNA, 23 bp, Artificial Sequence
  Synthetic
ccgttttttttttttggcaagtc

SEQ ID NO: 20244 - DNA, 23 bp, Artificial Sequence
  Synthetic
ccgttttttttttttggcaagtc

SEQ ID NO: 20245 - DNA, 23 bp, Artificial Sequence
  Synthetic
ccgttttttttttttggcaagtc

SEQ ID NO: 20246 - DNA, 23 bp, Artificial Sequence
  Synthetic
ccgttttttttttttgcaagtca

SEQ ID NO: 20247 - DNA, 23 bp, Artificial Sequence
  Synthetic
ccgttttttttttttattggcac

SEQ ID NO: 20248 - DNA, 23 bp, Artificial Sequence
  Synthetic
ccgttttttttttttattggcac

SEQ ID NO: 20249 - DNA, 23 bp, Artificial Sequence
  Synthetic
ccgttttttttttttattggctc

SEQ ID NO: 20250 - DNA, 23 bp, Artificial Sequence
  Synthetic
ccgttttttttttttattggcac

SEQ ID NO: 20251 - DNA, 23 bp, Artificial Sequence
  Synthetic
ccgttttttttttttgatattgg

SEQ ID NO: 20252 - DNA, 23 bp, Artificial Sequence
  Synthetic
ccgttttttttttttgatattgg

SEQ ID NO: 20253 - DNA, 23 bp, Artificial Sequence
  Synthetic
ccgttttttttttttagcatcat

SEQ ID NO: 20254 - DNA, 23 bp, Artificial Sequence
  Synthetic
ccgttttttttttttagcatcat

SEQ ID NO: 20255 - DNA, 23 bp, Artificial Sequence
  Synthetic
ccgttttttttttttagcatcat

SEQ ID NO: 20256 - DNA, 23 bp, Artificial Sequence
  Synthetic
ccgttttttttttttagcatcat

SEQ ID NO: 20257 - DNA, 23 bp, Artificial Sequence
  Synthetic
ccgttttttttttttcagcatca

SEQ ID NO: 20258 - DNA, 23 bp, Artificial Sequence
  Synthetic
ccgttttttttttttgagcaccc

SEQ ID NO: 20259 - DNA, 23 bp, Artificial Sequence
  Synthetic
ccgttttttttttttcaatgcga

SEQ ID NO: 20260 - DNA, 23 bp, Artificial Sequence
  Synthetic
ccgttttttttttttaggtggac

SEQ ID NO: 20261 - DNA, 23 bp, Artificial Sequence
  Synthetic
ccgttttttttttttaggtggac

SEQ ID NO: 20262 - DNA, 23 bp, Artificial Sequence
  Synthetic
ccgttttttttttttgttccccc

SEQ ID NO: 20263 - DNA, 23 bp, Artificial Sequence
  Synthetic
ccgttttttttttttgttccccc

SEQ ID NO: 20264 - DNA, 23 bp, Artificial Sequence
  Synthetic
ccgttttttttttttgttccccc

SEQ ID NO: 20265 - DNA, 23 bp, Artificial Sequence
  Synthetic
ccgttttttttttttgttccccc

SEQ ID NO: 20266 - DNA, 23 bp, Artificial Sequence
  Synthetic
ccgttttttttttttgttccccc

SEQ ID NO: 20267 - DNA, 23 bp, Artificial Sequence
  Synthetic
ccgttttttttttttgttccccc

SEQ ID NO: 20268 - DNA, 23 bp, Artificial Sequence
  Synthetic
ccgttttttttttttgttcaaga

SEQ ID NO: 20269 - DNA, 23 bp, Artificial Sequence
  Synthetic
ccgttttttttttttgttcaaga

SEQ ID NO: 20270 - DNA, 23 bp, Artificial Sequence
  Synthetic
ccgttttttttttttgttcaaga

SEQ ID NO: 20271 - DNA, 23 bp, Artificial Sequence
  Synthetic
ccgttttttttttttgggcaatt

SEQ ID NO: 20272 - DNA, 23 bp, Artificial Sequence
  Synthetic
ccgttttttttttttgggcagct

SEQ ID NO: 20273 - DNA, 23 bp, Artificial Sequence
  Synthetic
ccgttttttttttttgggcaatt

SEQ ID NO: 20274 - DNA, 23 bp, Artificial Sequence
  Synthetic
ccgttttttttttttgggcaact

SEQ ID NO: 20275 - DNA, 23 bp, Artificial Sequence
  Synthetic
ccgttttttttttttggcaaatc

SEQ ID NO: 20276 - DNA, 23 bp, Artificial Sequence
  Synthetic
ccgttttttttttttggcaaatc

SEQ ID NO: 20277 - DNA, 23 bp, Artificial Sequence
  Synthetic
ccgttttttttttttgggcaaat

SEQ ID NO: 20278 - DNA, 23 bp, Artificial Sequence
  Synthetic
ccgttttttttttttgggcaatt

SEQ ID NO: 20279 - DNA, 23 bp, Artificial Sequence
  Synthetic
ccgttttttttttttgggcaact

SEQ ID NO: 20280 - DNA, 23 bp, Artificial Sequence
  Synthetic
ccgttttttttttttcaagttcg

SEQ ID NO: 20281 - DNA, 23 bp, Artificial Sequence
  Synthetic
ccgttttttttttttagttatca

SEQ ID NO: 20282 - DNA, 23 bp, Artificial Sequence
  Synthetic
ccgttttttttttttaggagtct

SEQ ID NO: 20283 - DNA, 23 bp, Artificial Sequence
  Synthetic
ccgttttttttttttacctgcac

SEQ ID NO: 20284 - DNA, 23 bp, Artificial Sequence
  Synthetic
ccgttttttttttttgcactgtc

SEQ ID NO: 20285 - DNA, 23 bp, Artificial Sequence
  Synthetic
ccgttttttttttttcaaattcg

SEQ ID NO: 20286 - DNA, 23 bp, Artificial Sequence
  Synthetic
ccgttttttttttttcaagttag

SEQ ID NO: 20287 - DNA, 23 bp, Artificial Sequence
  Synthetic
ccgttttttttttttccaagctc

SEQ ID NO: 20288 - DNA, 23 bp, Artificial Sequence
  Synthetic
ccgttttttttttttaagagacc

SEQ ID NO: 20289 - DNA, 23 bp, Artificial Sequence
  Synthetic
ccgttttttttttttagctggtt

SEQ ID NO: 20290 - DNA, 23 bp, Artificial Sequence
  Synthetic
ccgttttttttttttagaagcat

SEQ ID NO: 20291 - DNA, 23 bp, Artificial Sequence
  Synthetic
ccgttttttttttttcaaaccat

SEQ ID NO: 20292 - DNA, 23 bp, Artificial Sequence
  Synthetic
ccgttttttttttttccaatatt

SEQ ID NO: 20293 - DNA, 23 bp, Artificial Sequence
  Synthetic
ccgttttttttttttaagtgcct

SEQ ID NO: 20294 - DNA, 23 bp, Artificial Sequence
  Synthetic
ccgttttttttttttacctgcac

SEQ ID NO: 20295 - DNA, 23 bp, Artificial Sequence
  Synthetic
ccgttttttttttttgcactaga

SEQ ID NO: 20296 - DNA, 23 bp, Artificial Sequence
  Synthetic
ccgttttttttttttcaccgaca

SEQ ID NO: 20297 - DNA, 23 bp, Artificial Sequence
  Synthetic
ccgttttttttttttgtgaattc

SEQ ID NO: 20298 - DNA, 23 bp, Artificial Sequence
  Synthetic
ccgttttttttttttagctcccc

SEQ ID NO: 20299 - DNA, 23 bp, Artificial Sequence
  Synthetic
ccgttttttttttttacaggtag

SEQ ID NO: 20300 - DNA, 23 bp, Artificial Sequence
  Synthetic
ccgttttttttttttgttttgca

SEQ ID NO: 20301 - DNA, 23 bp, Artificial Sequence
  Synthetic
ccgttttttttttttgttttgca

SEQ ID NO: 20302 - DNA, 23 bp, Artificial Sequence
  Synthetic
ccgttttttttttttctgcacta

SEQ ID NO: 20303 - DNA, 23 bp, Artificial Sequence
  Synthetic
ccgttttttttttttgcatagga

SEQ ID NO: 20304 - DNA, 23 bp, Artificial Sequence
  Synthetic
ccgttttttttttttcctgtctg

SEQ ID NO: 20305 - DNA, 23 bp, Artificial Sequence
  Synthetic
ccgttttttttttttatggttag

SEQ ID NO: 20306 - DNA, 23 bp, Artificial Sequence
  Synthetic
ccgttttttttttttagttcttc

SEQ ID NO: 20307 - DNA, 23 bp, Artificial Sequence
  Synthetic
ccgttttttttttttggtatttg

SEQ ID NO: 20308 - DNA, 23 bp, Artificial Sequence
  Synthetic
ccgttttttttttttaaatccct

SEQ ID NO: 20309 - DNA, 23 bp, Artificial Sequence
  Synthetic
ccgttttttttttttcggaactt

SEQ ID NO: 20310 - DNA, 23 bp, Artificial Sequence
  Synthetic
ccgttttttttttttaatagact

SEQ ID NO: 20311 - DNA, 23 bp, Artificial Sequence
  Synthetic
ccgttttttttttttccgatttc

SEQ ID NO: 20312 - DNA, 23 bp, Artificial Sequence
  Synthetic
ccgttttttttttttgatttcaa

SEQ ID NO: 20313 - DNA, 23 bp, Artificial Sequence
  Synthetic
ccgttttttttttttaacttagt

SEQ ID NO: 20314 - DNA, 23 bp, Artificial Sequence
  Synthetic
ccgttttttttttttaaccagct

SEQ ID NO: 20315 - DNA, 23 bp, Artificial Sequence
  Synthetic
ccgttttttttttttcaaaatca

SEQ ID NO: 20316 - DNA, 23 bp, Artificial Sequence
  Synthetic
ccgttttttttttttaggccggg

SEQ ID NO: 20317 - DNA, 23 bp, Artificial Sequence
  Synthetic
ccgttttttttttttcctgcacg

SEQ ID NO: 20318 - DNA, 23 bp, Artificial Sequence
  Synthetic
ccgttttttttttttcaataaat

SEQ ID NO: 20319 - DNA, 23 bp, Artificial Sequence
  Synthetic
ccgttttttttttttaaaaatgt

SEQ ID NO: 20320 - DNA, 23 bp, Artificial Sequence
  Synthetic
ccgttttttttttttagctttca

SEQ ID NO: 20321 - DNA, 23 bp, Artificial Sequence
  Synthetic
ccgttttttttttttagctttcg

SEQ ID NO: 20322 - DNA, 23 bp, Artificial Sequence
  Synthetic
ccgttttttttttttaagctttc

SEQ ID NO: 20323 - DNA, 23 bp, Artificial Sequence
  Synthetic
ccgttttttttttttcatccaac

SEQ ID NO: 20324 - DNA, 23 bp, Artificial Sequence
  Synthetic
ccgttttttttttttcatccaac

SEQ ID NO: 20325 - DNA, 23 bp, Artificial Sequence
  Synthetic
ccgttttttttttttgaagacag

SEQ ID NO: 20326 - DNA, 23 bp, Artificial Sequence
  Synthetic
ccgttttttttttttccttttga

SEQ ID NO: 20327 - DNA, 23 bp, Artificial Sequence
  Synthetic
ccgttttttttttttacagtcga

SEQ ID NO: 20328 - DNA, 23 bp, Artificial Sequence
  Synthetic
ccgttttttttttttaactcgga

SEQ ID NO: 20329 - DNA, 23 bp, Artificial Sequence
  Synthetic
ccgttttttttttttccttgaag

SEQ ID NO: 20330 - DNA, 23 bp, Artificial Sequence
  Synthetic
ccgttttttttttttactcctga

SEQ ID NO: 20331 - DNA, 23 bp, Artificial Sequence
  Synthetic
ccgttttttttttttgcattcac

SEQ ID NO: 20332 - DNA, 23 bp, Artificial Sequence
  Synthetic
ccgttttttttttttgcattcac

SEQ ID NO: 20333 - DNA, 23 bp, Artificial Sequence
  Synthetic
ccgttttttttttttcattcacc

SEQ ID NO: 20334 - DNA, 23 bp, Artificial Sequence
  Synthetic
ccgttttttttttttaaaggtca

SEQ ID NO: 20335 - DNA, 23 bp, Artificial Sequence
  Synthetic
ccgttttttttttttcagtcaat

SEQ ID NO: 20336 - DNA, 23 bp, Artificial Sequence
  Synthetic
ccgttttttttttttctgatacc

SEQ ID NO: 20337 - DNA, 23 bp, Artificial Sequence
  Synthetic
ccgttttttttttttgcatatta

SEQ ID NO: 20338 - DNA, 23 bp, Artificial Sequence
  Synthetic
ccgttttttttttttctttagca

SEQ ID NO: 20339 - DNA, 23 bp, Artificial Sequence
  Synthetic
ccgttttttttttttggttgatg

SEQ ID NO: 20340 - DNA, 23 bp, Artificial Sequence
  Synthetic
ccgttttttttttttagcaaacc

SEQ ID NO: 20341 - DNA, 23 bp, Artificial Sequence
  Synthetic
ccgttttttttttttccaattaa

SEQ ID NO: 20342 - DNA, 23 bp, Artificial Sequence
  Synthetic
ccgttttttttttttatatgctc

SEQ ID NO: 20343 - DNA, 23 bp, Artificial Sequence
  Synthetic
ccgttttttttttttccaataaa

SEQ ID NO: 20344 - DNA, 23 bp, Artificial Sequence
  Synthetic
ccgttttttttttttacgataca

SEQ ID NO: 20345 - DNA, 23 bp, Artificial Sequence
  Synthetic
ccgttttttttttttcatatttc

SEQ ID NO: 20346 - DNA, 23 bp, Artificial Sequence
  Synthetic
ccgttttttttttttccataatt

SEQ ID NO: 20347 - DNA, 23 bp, Artificial Sequence
  Synthetic
ccgttttttttttttcactattc

SEQ ID NO: 20348 - DNA, 23 bp, Artificial Sequence
  Synthetic
ccgttttttttttttgaactgcg

SEQ ID NO: 20349 - DNA, 23 bp, Artificial Sequence
  Synthetic
ccgttttttttttttatatccga

SEQ ID NO: 20350 - DNA, 23 bp, Artificial Sequence
  Synthetic
ccgttttttttttttgccagata

SEQ ID NO: 20351 - DNA, 23 bp, Artificial Sequence
  Synthetic
ccgttttttttttttagctgcat

SEQ ID NO: 20352 - DNA, 23 bp, Artificial Sequence
  Synthetic
ccgttttttttttttataccaga

SEQ ID NO: 20353 - DNA, 23 bp, Artificial Sequence
  Synthetic
ccgttttttttttttgccagata

SEQ ID NO: 20354 - DNA, 23 bp, Artificial Sequence
  Synthetic
ccgttttttttttttaatgttac

SEQ ID NO: 20355 - DNA, 23 bp, Artificial Sequence
  Synthetic
ccgttttttttttttagagcata

SEQ ID NO: 20356 - DNA, 23 bp, Artificial Sequence
  Synthetic
ccgttttttttttttctcatgaa

SEQ ID NO: 20357 - DNA, 23 bp, Artificial Sequence
  Synthetic
ccgttttttttttttcgttccaa

SEQ ID NO: 20358 - DNA, 23 bp, Artificial Sequence
  Synthetic
ccgttttttttttttcacaacac

SEQ ID NO: 20359 - DNA, 23 bp, Artificial Sequence
  Synthetic
ccgttttttttttttcatcaaaa

SEQ ID NO: 20360 - DNA, 23 bp, Artificial Sequence
  Synthetic
ccgttttttttttttacaaccaa

SEQ ID NO: 20361 - DNA, 23 bp, Artificial Sequence
  Synthetic
ccgttttttttttttatcatcag

SEQ ID NO: 20362 - DNA, 23 bp, Artificial Sequence
  Synthetic
ccgttttttttttttacatcaaa

SEQ ID NO: 20363 - DNA, 23 bp, Artificial Sequence
  Synthetic
ccgttttttttttttgttatgcc

SEQ ID NO: 20364 - DNA, 23 bp, Artificial Sequence
  Synthetic
ccgttttttttttttgctatgcc

SEQ ID NO: 20365 - DNA, 23 bp, Artificial Sequence
  Synthetic
ccgttttttttttttgaatgtct

SEQ ID NO: 20366 - DNA, 23 bp, Artificial Sequence
  Synthetic
ccgttttttttttttaccaagta

SEQ ID NO: 20367 - DNA, 23 bp, Artificial Sequence
  Synthetic
ccgttttttttttttagtaagtg

SEQ ID NO: 20368 - DNA, 23 bp, Artificial Sequence
  Synthetic
ccgttttttttttttcctcgttc

SEQ ID NO: 20369 - DNA, 23 bp, Artificial Sequence
  Synthetic
ccgttttttttttttcactaccc

SEQ ID NO: 20370 - DNA, 23 bp, Artificial Sequence
  Synthetic
ccgttttttttttttccactacc

SEQ ID NO: 20371 - DNA, 23 bp, Artificial Sequence
  Synthetic
ccgttttttttttttaaaaacac

SEQ ID NO: 20372 - DNA, 23 bp, Artificial Sequence
  Synthetic
ccgttttttttttttcactaccc

SEQ ID NO: 20373 - DNA, 23 bp, Artificial Sequence
  Synthetic
ccgttttttttttttacagctct

SEQ ID NO: 20374 - DNA, 23 bp, Artificial Sequence
  Synthetic
ccgttttttttttttccgatata

SEQ ID NO: 20375 - DNA, 23 bp, Artificial Sequence
  Synthetic
ccgttttttttttttcaattacc

SEQ ID NO: 20376 - DNA, 23 bp, Artificial Sequence
  Synthetic
ccgttttttttttttattacact

SEQ ID NO: 20377 - DNA, 23 bp, Artificial Sequence
  Synthetic
ccgttttttttttttcaccgagg

SEQ ID NO: 20378 - DNA, 23 bp, Artificial Sequence
  Synthetic
ccgttttttttttttaactggaa

SEQ ID NO: 20379 - DNA, 23 bp, Artificial Sequence
  Synthetic
ccgttttttttttttatggccat

SEQ ID NO: 20380 - DNA, 23 bp, Artificial Sequence
  Synthetic
ccgttttttttttttaccaccaa

SEQ ID NO: 20381 - DNA, 23 bp, Artificial Sequence
  Synthetic
ccgttttttttttttgatcacaa

SEQ ID NO: 20382 - DNA, 23 bp, Artificial Sequence
  Synthetic
ccgttttttttttttaataaccc

SEQ ID NO: 20383 - DNA, 23 bp, Artificial Sequence
  Synthetic
ccgttttttttttttgaaataca

SEQ ID NO: 20384 - DNA, 23 bp, Artificial Sequence
  Synthetic
ccgttttttttttttccaaatta

SEQ ID NO: 20385 - DNA, 23 bp, Artificial Sequence
  Synthetic
ccgttttttttttttactttggt

SEQ ID NO: 20386 - DNA, 23 bp, Artificial Sequence
  Synthetic
ccgttttttttttttactaaatc

SEQ ID NO: 20387 - DNA, 23 bp, Artificial Sequence
  Synthetic
ccgttttttttttttaacgaaat

SEQ ID NO: 20388 - DNA, 23 bp, Artificial Sequence
  Synthetic
ccgttttttttttttgcaaatca

SEQ ID NO: 20389 - DNA, 23 bp, Artificial Sequence
  Synthetic
ccgttttttttttttcatcgtta

SEQ ID NO: 20390 - DNA, 23 bp, Artificial Sequence
  Synthetic
ccgttttttttttttacttgaaa

SEQ ID NO: 20391 - DNA, 23 bp, Artificial Sequence
  Synthetic
ccgttttttttttttatttgaag

SEQ ID NO: 20392 - DNA, 23 bp, Artificial Sequence
  Synthetic
ccgttttttttttttaattaact

SEQ ID NO: 20393 - DNA, 23 bp, Artificial Sequence
  Synthetic
ccgttttttttttttctcactct

SEQ ID NO: 20394 - DNA, 23 bp, Artificial Sequence
  Synthetic
ccgttttttttttttgagctccc

SEQ ID NO: 20395 - DNA, 23 bp, Artificial Sequence
  Synthetic
ccgttttttttttttgagctccc

SEQ ID NO: 20396 - DNA, 23 bp, Artificial Sequence
  Synthetic
ccgttttttttttttgagctccc

SEQ ID NO: 20397 - DNA, 23 bp, Artificial Sequence
  Synthetic
ccgttttttttttttgagctccc

SEQ ID NO: 20398 - DNA, 23 bp, Artificial Sequence
  Synthetic
ccgttttttttttttgagctcct

SEQ ID NO: 20399 - DNA, 23 bp, Artificial Sequence
  Synthetic
ccgttttttttttttgatcatgc

SEQ ID NO: 20400 - DNA, 23 bp, Artificial Sequence
  Synthetic
ccgttttttttttttgatcatgc

SEQ ID NO: 20401 - DNA, 23 bp, Artificial Sequence
  Synthetic
ccgttttttttttttccgatctg

SEQ ID NO: 20402 - DNA, 23 bp, Artificial Sequence
  Synthetic
ccgttttttttttttccgatctg

SEQ ID NO: 20403 - DNA, 23 bp, Artificial Sequence
  Synthetic
ccgttttttttttttgttcaaga

SEQ ID NO: 20404 - DNA, 23 bp, Artificial Sequence
  Synthetic
ccgttttttttttttcagggaag

SEQ ID NO: 20405 - DNA, 23 bp, Artificial Sequence
  Synthetic
ccgttttttttttttcagggaag

SEQ ID NO: 20406 - DNA, 23 bp, Artificial Sequence
  Synthetic
ccgttttttttttttcagggaag

SEQ ID NO: 20407 - DNA, 23 bp, Artificial Sequence
  Synthetic
ccgttttttttttttcagggaag

SEQ ID NO: 20408 - DNA, 23 bp, Artificial Sequence
  Synthetic
ccgttttttttttttcagggaag

SEQ ID NO: 20409 - DNA, 23 bp, Artificial Sequence
  Synthetic
ccgttttttttttttccatacaa

SEQ ID NO: 20410 - DNA, 23 bp, Artificial Sequence
  Synthetic
ccgttttttttttttctatacaa

SEQ ID NO: 20411 - DNA, 23 bp, Artificial Sequence
  Synthetic
ccgttttttttttttcacaaact

SEQ ID NO: 20412 - DNA, 23 bp, Artificial Sequence
  Synthetic
ccgttttttttttttagccctgt

SEQ ID NO: 20413 - DNA, 23 bp, Artificial Sequence
  Synthetic
ccgttttttttttttaggagtct

SEQ ID NO: 20414 - DNA, 23 bp, Artificial Sequence
  Synthetic
ccgttttttttttttaggagtct

SEQ ID NO: 20415 - DNA, 23 bp, Artificial Sequence
  Synthetic
ccgttttttttttttacctgcac

SEQ ID NO: 20416 - DNA, 23 bp, Artificial Sequence
  Synthetic
ccgttttttttttttagccctgt

SEQ ID NO: 20417 - DNA, 23 bp, Artificial Sequence
  Synthetic
ccgttttttttttttaaacacca

SEQ ID NO: 20418 - DNA, 23 bp, Artificial Sequence
  Synthetic
ccgttttttttttttcattcacc

SEQ ID NO: 20419 - DNA, 23 bp, Artificial Sequence
  Synthetic
ccgttttttttttttcaagttag

SEQ ID NO: 20420 - DNA, 23 bp, Artificial Sequence
  Synthetic
ccgttttttttttttaagagacc

SEQ ID NO: 20421 - DNA, 23 bp, Artificial Sequence
  Synthetic
ccgttttttttttttcataggaa

SEQ ID NO: 20422 - DNA, 23 bp, Artificial Sequence
  Synthetic
ccgttttttttttttatcatcaa

SEQ ID NO: 20423 - DNA, 23 bp, Artificial Sequence
  Synthetic
ccgttttttttttttacacgtgc

SEQ ID NO: 20424 - DNA, 23 bp, Artificial Sequence
  Synthetic
ccgttttttttttttccataggg

SEQ ID NO: 20425 - DNA, 23 bp, Artificial Sequence
  Synthetic
ccgttttttttttttgggattcc

SEQ ID NO: 20426 - DNA, 23 bp, Artificial Sequence
  Synthetic
ccgttttttttttttaaagttct

SEQ ID NO: 20427 - DNA, 23 bp, Artificial Sequence
  Synthetic
ccgttttttttttttcttttgtg

SEQ ID NO: 20428 - DNA, 23 bp, Artificial Sequence
  Synthetic
ccgttttttttttttaaccatga

SEQ ID NO: 20429 - DNA, 23 bp, Artificial Sequence
  Synthetic
ccgttttttttttttgcactaga

SEQ ID NO: 20430 - DNA, 23 bp, Artificial Sequence
  Synthetic
ccgttttttttttttcccaccga

SEQ ID NO: 20431 - DNA, 23 bp, Artificial Sequence
  Synthetic
ccgttttttttttttcaccgaca

SEQ ID NO: 20432 - DNA, 23 bp, Artificial Sequence
  Synthetic
ccgttttttttttttgtgaattc

SEQ ID NO: 20433 - DNA, 23 bp, Artificial Sequence
  Synthetic
ccgttttttttttttccttatca

SEQ ID NO: 20434 - DNA, 23 bp, Artificial Sequence
  Synthetic
ccgttttttttttttgcccaaaa

SEQ ID NO: 20435 - DNA, 23 bp, Artificial Sequence
  Synthetic
ccgttttttttttttaacaacat

SEQ ID NO: 20436 - DNA, 23 bp, Artificial Sequence
  Synthetic
ccgttttttttttttgttttgca

SEQ ID NO: 20437 - DNA, 23 bp, Artificial Sequence
  Synthetic
ccgttttttttttttctgcacta

SEQ ID NO: 20438 - DNA, 23 bp, Artificial Sequence
  Synthetic
ccgttttttttttttgcatagga

SEQ ID NO: 20439 - DNA, 23 bp, Artificial Sequence
  Synthetic
ccgttttttttttttgactccgg

SEQ ID NO: 20440 - DNA, 23 bp, Artificial Sequence
  Synthetic
ccgttttttttttttacatcagt

SEQ ID NO: 20441 - DNA, 23 bp, Artificial Sequence
  Synthetic
ccgttttttttttttcctgtctg

SEQ ID NO: 20442 - DNA, 23 bp, Artificial Sequence
  Synthetic
ccgttttttttttttcagttgcc

SEQ ID NO: 20443 - DNA, 23 bp, Artificial Sequence
  Synthetic
ccgttttttttttttcaatcagt

SEQ ID NO: 20444 - DNA, 23 bp, Artificial Sequence
  Synthetic
ccgttttttttttttacggaacc

SEQ ID NO: 20445 - DNA, 23 bp, Artificial Sequence
  Synthetic
ccgttttttttttttaaatccct

SEQ ID NO: 20446 - DNA, 23 bp, Artificial Sequence
  Synthetic
ccgttttttttttttcctgctga

SEQ ID NO: 20447 - DNA, 23 bp, Artificial Sequence
  Synthetic
ccgttttttttttttcctatcct

SEQ ID NO: 20448 - DNA, 23 bp, Artificial Sequence
  Synthetic
ccgttttttttttttggaactta

SEQ ID NO: 20449 - DNA, 23 bp, Artificial Sequence
  Synthetic
ccgttttttttttttaatagagt

SEQ ID NO: 20450 - DNA, 23 bp, Artificial Sequence
  Synthetic
ccgttttttttttttgatttcaa

SEQ ID NO: 20451 - DNA, 23 bp, Artificial Sequence
  Synthetic
ccgttttttttttttccgatttc

SEQ ID NO: 20452 - DNA, 23 bp, Artificial Sequence
  Synthetic
ccgttttttttttttgacaatac

SEQ ID NO: 20453 - DNA, 23 bp, Artificial Sequence
  Synthetic
ccgttttttttttttgagagtgt

SEQ ID NO: 20454 - DNA, 23 bp, Artificial Sequence
  Synthetic
ccgttttttttttttaacttagt

SEQ ID NO: 20455 - DNA, 23 bp, Artificial Sequence
  Synthetic
ccgttttttttttttaggtcgac

SEQ ID NO: 20456 - DNA, 23 bp, Artificial Sequence
  Synthetic
ccgttttttttttttacttactg

SEQ ID NO: 20457 - DNA, 23 bp, Artificial Sequence
  Synthetic
ccgttttttttttttgaggaagg

SEQ ID NO: 20458 - DNA, 23 bp, Artificial Sequence
  Synthetic
ccgttttttttttttcaaaatca

SEQ ID NO: 20459 - DNA, 23 bp, Artificial Sequence
  Synthetic
ccgttttttttttttacagctag

SEQ ID NO: 20460 - DNA, 23 bp, Artificial Sequence
  Synthetic
ccgttttttttttttacagctag

SEQ ID NO: 20461 - DNA, 23 bp, Artificial Sequence
  Synthetic
ccgttttttttttttcaataaat

SEQ ID NO: 20462 - DNA, 23 bp, Artificial Sequence
  Synthetic
ccgttttttttttttcagggcat

SEQ ID NO: 20463 - DNA, 23 bp, Artificial Sequence
  Synthetic
ccgttttttttttttggctcatt

SEQ ID NO: 20464 - DNA, 23 bp, Artificial Sequence
  Synthetic
ccgttttttttttttctatacaa

SEQ ID NO: 20465 - DNA, 23 bp, Artificial Sequence
  Synthetic
ccgttttttttttttccacacaa

SEQ ID NO: 20466 - DNA, 23 bp, Artificial Sequence
  Synthetic
ccgttttttttttttccatacaa

SEQ ID NO: 20467 - DNA, 23 bp, Artificial Sequence
  Synthetic
ccgttttttttttttctattcaa

SEQ ID NO: 20468 - DNA, 23 bp, Artificial Sequence
  Synthetic
ccgttttttttttttctatacaa

SEQ ID NO: 20469 - DNA, 23 bp, Artificial Sequence
  Synthetic
ccgttttttttttttcaacacaa

SEQ ID NO: 20470 - DNA, 23 bp, Artificial Sequence
  Synthetic
ccgttttttttttttcagcacaa

SEQ ID NO: 20471 - DNA, 23 bp, Artificial Sequence
  Synthetic
ccgttttttttttttctgtacaa

SEQ ID NO: 20472 - DNA, 23 bp, Artificial Sequence
  Synthetic
ccgttttttttttttcatacttc

SEQ ID NO: 20473 - DNA, 23 bp, Artificial Sequence
  Synthetic
ccgttttttttttttcaagttcg

SEQ ID NO: 20474 - DNA, 23 bp, Artificial Sequence
  Synthetic
ccgttttttttttttagttatca

SEQ ID NO: 20475 - DNA, 23 bp, Artificial Sequence
  Synthetic
ccgttttttttttttagttatca

SEQ ID NO: 20476 - DNA, 23 bp, Artificial Sequence
  Synthetic
ccgttttttttttttagccctgt

SEQ ID NO: 20477 - DNA, 23 bp, Artificial Sequence
  Synthetic
ccgttttttttttttagccctgt

SEQ ID NO: 20478 - DNA, 23 bp, Artificial Sequence
  Synthetic
ccgttttttttttttcaaattcg

SEQ ID NO: 20479 - DNA, 23 bp, Artificial Sequence
  Synthetic
ccgttttttttttttaaatccgg

SEQ ID NO: 20480 - DNA, 23 bp, Artificial Sequence
  Synthetic
ccgttttttttttttcacacatt

SEQ ID NO: 20481 - DNA, 23 bp, Artificial Sequence
  Synthetic
ccgttttttttttttaacaccat

SEQ ID NO: 20482 - DNA, 23 bp, Artificial Sequence
  Synthetic
ccgttttttttttttcattcacc

SEQ ID NO: 20483 - DNA, 23 bp, Artificial Sequence
  Synthetic
ccgttttttttttttcaggttaa

SEQ ID NO: 20484 - DNA, 23 bp, Artificial Sequence
  Synthetic
ccgttttttttttttcaagttag

SEQ ID NO: 20485 - DNA, 23 bp, Artificial Sequence
  Synthetic
ccgttttttttttttattattac

SEQ ID NO: 20486 - DNA, 23 bp, Artificial Sequence
  Synthetic
ccgttttttttttttaagagacc

SEQ ID NO: 20487 - DNA, 23 bp, Artificial Sequence
  Synthetic
ccgttttttttttttcaagccca

SEQ ID NO: 20488 - DNA, 23 bp, Artificial Sequence
  Synthetic
ccgttttttttttttccctttta

SEQ ID NO: 20489 - DNA, 23 bp, Artificial Sequence
  Synthetic
ccgttttttttttttaccatggc

SEQ ID NO: 20490 - DNA, 23 bp, Artificial Sequence
  Synthetic
ccgttttttttttttgctggttg

SEQ ID NO: 20491 - DNA, 23 bp, Artificial Sequence
  Synthetic
ccgttttttttttttcataggaa

SEQ ID NO: 20492 - DNA, 23 bp, Artificial Sequence
  Synthetic
ccgttttttttttttgataggaa

SEQ ID NO: 20493 - DNA, 23 bp, Artificial Sequence
  Synthetic
ccgttttttttttttgcgtattc

SEQ ID NO: 20494 - DNA, 23 bp, Artificial Sequence
  Synthetic
ccgttttttttttttcctgattc

SEQ ID NO: 20495 - DNA, 23 bp, Artificial Sequence
  Synthetic
ccgttttttttttttccataggg

SEQ ID NO: 20496 - DNA, 23 bp, Artificial Sequence
  Synthetic
ccgttttttttttttagtgcttt

SEQ ID NO: 20497 - DNA, 23 bp, Artificial Sequence
  Synthetic
ccgttttttttttttagtgcttt

SEQ ID NO: 20498 - DNA, 23 bp, Artificial Sequence
  Synthetic
ccgttttttttttttacatcatc

SEQ ID NO: 20499 - DNA, 23 bp, Artificial Sequence
  Synthetic
ccgttttttttttttaaagttct

SEQ ID NO: 20500 - DNA, 23 bp, Artificial Sequence
  Synthetic
ccgttttttttttttaaagttct

SEQ ID NO: 20501 - DNA, 23 bp, Artificial Sequence
  Synthetic
ccgttttttttttttcacttttg

SEQ ID NO: 20502 - DNA, 23 bp, Artificial Sequence
  Synthetic
ccgttttttttttttcatttttg

SEQ ID NO: 20503 - DNA, 23 bp, Artificial Sequence
  Synthetic
ccgttttttttttttcaaaccat

SEQ ID NO: 20504 - DNA, 23 bp, Artificial Sequence
  Synthetic
ccgttttttttttttaaaccatg

SEQ ID NO: 20505 - DNA, 23 bp, Artificial Sequence
  Synthetic
ccgttttttttttttcaatattt

SEQ ID NO: 20506 - DNA, 23 bp, Artificial Sequence
  Synthetic
ccgttttttttttttctgcactg

SEQ ID NO: 20507 - DNA, 23 bp, Artificial Sequence
  Synthetic
ccgttttttttttttgcactaga

SEQ ID NO: 20508 - DNA, 23 bp, Artificial Sequence
  Synthetic
ccgttttttttttttcaccgaca

SEQ ID NO: 20509 - DNA, 23 bp, Artificial Sequence
  Synthetic
ccgttttttttttttacaatcaa

SEQ ID NO: 20510 - DNA, 23 bp, Artificial Sequence
  Synthetic
ccgttttttttttttcaccgaca

SEQ ID NO: 20511 - DNA, 23 bp, Artificial Sequence
  Synthetic
ccgttttttttttttggcaagtc

SEQ ID NO: 20512 - DNA, 23 bp, Artificial Sequence
  Synthetic
ccgttttttttttttgtgaattc

SEQ ID NO: 20513 - DNA, 23 bp, Artificial Sequence
  Synthetic
ccgttttttttttttcttatcag

SEQ ID NO: 20514 - DNA, 23 bp, Artificial Sequence
  Synthetic
ccgttttttttttttctgcaaca

SEQ ID NO: 20515 - DNA, 23 bp, Artificial Sequence
  Synthetic
ccgttttttttttttctaatata

SEQ ID NO: 20516 - DNA, 23 bp, Artificial Sequence
  Synthetic
ccgttttttttttttctgtcaat

SEQ ID NO: 20517 - DNA, 23 bp, Artificial Sequence
  Synthetic
ccgttttttttttttgggacttt

SEQ ID NO: 20518 - DNA, 23 bp, Artificial Sequence
  Synthetic
ccgttttttttttttacatggag

SEQ ID NO: 20519 - DNA, 23 bp, Artificial Sequence
  Synthetic
ccgttttttttttttcaacaaca

SEQ ID NO: 20520 - DNA, 23 bp, Artificial Sequence
  Synthetic
ccgttttttttttttcaacaact

SEQ ID NO: 20521 - DNA, 23 bp, Artificial Sequence
  Synthetic
ccgttttttttttttacaggtag

SEQ ID NO: 20522 - DNA, 23 bp, Artificial Sequence
  Synthetic
ccgttttttttttttgttttgca

SEQ ID NO: 20523 - DNA, 23 bp, Artificial Sequence
  Synthetic
ccgttttttttttttgttttgca

SEQ ID NO: 20524 - DNA, 23 bp, Artificial Sequence
  Synthetic
ccgttttttttttttcctgcact

SEQ ID NO: 20525 - DNA, 23 bp, Artificial Sequence
  Synthetic
ccgttttttttttttatcgttac

SEQ ID NO: 20526 - DNA, 23 bp, Artificial Sequence
  Synthetic
ccgttttttttttttcattacca

SEQ ID NO: 20527 - DNA, 23 bp, Artificial Sequence
  Synthetic
ccgttttttttttttcatgccct

SEQ ID NO: 20528 - DNA, 23 bp, Artificial Sequence
  Synthetic
ccgttttttttttttagtggtcc

SEQ ID NO: 20529 - DNA, 23 bp, Artificial Sequence
  Synthetic
ccgttttttttttttgcatagga

SEQ ID NO: 20530 - DNA, 23 bp, Artificial Sequence
  Synthetic
ccgttttttttttttgcatagga

SEQ ID NO: 20531 - DNA, 23 bp, Artificial Sequence
  Synthetic
ccgttttttttttttgactccgg

SEQ ID NO: 20532 - DNA, 23 bp, Artificial Sequence
  Synthetic
ccgttttttttttttcaacacca

SEQ ID NO: 20533 - DNA, 23 bp, Artificial Sequence
  Synthetic
ccgttttttttttttccgctgtc

SEQ ID NO: 20534 - DNA, 23 bp, Artificial Sequence
  Synthetic
ccgttttttttttttccatgact

SEQ ID NO: 20535 - DNA, 23 bp, Artificial Sequence
  Synthetic
ccgttttttttttttcctgtctg

SEQ ID NO: 20536 - DNA, 23 bp, Artificial Sequence
  Synthetic
ccgttttttttttttcagttgcc

SEQ ID NO: 20537 - DNA, 23 bp, Artificial Sequence
  Synthetic
ccgttttttttttttcagttgcc

SEQ ID NO: 20538 - DNA, 23 bp, Artificial Sequence
  Synthetic
ccgttttttttttttaatcagtt

SEQ ID NO: 20539 - DNA, 23 bp, Artificial Sequence
  Synthetic
ccgttttttttttttcatggtta

SEQ ID NO: 20540 - DNA, 23 bp, Artificial Sequence
  Synthetic
ccgttttttttttttatggttag

SEQ ID NO: 20541 - DNA, 23 bp, Artificial Sequence
  Synthetic
ccgttttttttttttgaattgcg

SEQ ID NO: 20542 - DNA, 23 bp, Artificial Sequence
  Synthetic
ccgttttttttttttaacccagc

SEQ ID NO: 20543 - DNA, 23 bp, Artificial Sequence
  Synthetic
ccgttttttttttttgacccagt

SEQ ID NO: 20544 - DNA, 23 bp, Artificial Sequence
  Synthetic
ccgttttttttttttggtatttg

SEQ ID NO: 20545 - DNA, 23 bp, Artificial Sequence
  Synthetic
ccgttttttttttttagttcttc

SEQ ID NO: 20546 - DNA, 23 bp, Artificial Sequence
  Synthetic
ccgttttttttttttagctcttc

SEQ ID NO: 20547 - DNA, 23 bp, Artificial Sequence
  Synthetic
ccgttttttttttttaaatccct

SEQ ID NO: 20548 - DNA, 23 bp, Artificial Sequence
  Synthetic
ccgttttttttttttaatccctg

SEQ ID NO: 20549 - DNA, 23 bp, Artificial Sequence
  Synthetic
ccgttttttttttttcctgctga

SEQ ID NO: 20550 - DNA, 23 bp, Artificial Sequence
  Synthetic
ccgttttttttttttgaccgaga

SEQ ID NO: 20551 - DNA, 23 bp, Artificial Sequence
  Synthetic
ccgttttttttttttcctatcct

SEQ ID NO: 20552 - DNA, 23 bp, Artificial Sequence
  Synthetic
ccgttttttttttttagaactta

SEQ ID NO: 20553 - DNA, 23 bp, Artificial Sequence
  Synthetic
ccgttttttttttttagaactta

SEQ ID NO: 20554 - DNA, 23 bp, Artificial Sequence
  Synthetic
ccgttttttttttttctgaactt

SEQ ID NO: 20555 - DNA, 23 bp, Artificial Sequence
  Synthetic
ccgttttttttttttccgatttc

SEQ ID NO: 20556 - DNA, 23 bp, Artificial Sequence
  Synthetic
ccgttttttttttttactgattt

SEQ ID NO: 20557 - DNA, 23 bp, Artificial Sequence
  Synthetic
ccgttttttttttttgacaatac

SEQ ID NO: 20558 - DNA, 23 bp, Artificial Sequence
  Synthetic
ccgttttttttttttctgagtgt

SEQ ID NO: 20559 - DNA, 23 bp, Artificial Sequence
  Synthetic
ccgttttttttttttgagagtgt

SEQ ID NO: 20560 - DNA, 23 bp, Artificial Sequence
  Synthetic
ccgttttttttttttcagtcggg

SEQ ID NO: 20561 - DNA, 23 bp, Artificial Sequence
  Synthetic
ccgttttttttttttacaaaatc

SEQ ID NO: 20562 - DNA, 23 bp, Artificial Sequence
  Synthetic
ccgttttttttttttaggatttt

SEQ ID NO: 20563 - DNA, 23 bp, Artificial Sequence
  Synthetic
ccgttttttttttttcgcgagcc

SEQ ID NO: 20564 - DNA, 23 bp, Artificial Sequence
  Synthetic
ccgttttttttttttggcattac

SEQ ID NO: 20565 - DNA, 23 bp, Artificial Sequence
  Synthetic
ccgttttttttttttatgtagtc

SEQ ID NO: 20566 - DNA, 23 bp, Artificial Sequence
  Synthetic
ccgttttttttttttagaaccat

SEQ ID NO: 20567 - DNA, 23 bp, Artificial Sequence
  Synthetic
ccgttttttttttttccacattg

SEQ ID NO: 20568 - DNA, 23 bp, Artificial Sequence
  Synthetic
ccgttttttttttttagccgtac

SEQ ID NO: 20569 - DNA, 23 bp, Artificial Sequence
  Synthetic
ccgttttttttttttaacaaaat

SEQ ID NO: 20570 - DNA, 23 bp, Artificial Sequence
  Synthetic
ccgttttttttttttacagctag

SEQ ID NO: 20571 - DNA, 23 bp, Artificial Sequence
  Synthetic
ccgttttttttttttaggccggg

SEQ ID NO: 20572 - DNA, 23 bp, Artificial Sequence
  Synthetic
ccgttttttttttttcaaaaatg

SEQ ID NO: 20573 - DNA, 23 bp, Artificial Sequence
  Synthetic
ccgttttttttttttagctggtt

SEQ ID NO: 20574 - DNA, 23 bp, Artificial Sequence
  Synthetic
ccgttttttttttttactgcact

SEQ ID NO: 20575 - DNA, 23 bp, Artificial Sequence
  Synthetic
ccgttttttttttttgttttgca

SEQ ID NO: 20576 - DNA, 23 bp, Artificial Sequence
  Synthetic
ccgttttttttttttcctgcact

SEQ ID NO: 20577 - DNA, 23 bp, Artificial Sequence
  Synthetic
ccgttttttttttttcccaaaac

SEQ ID NO: 20578 - DNA, 23 bp, Artificial Sequence
  Synthetic
ccgttttttttttttaccgaact

SEQ ID NO: 20579 - DNA, 23 bp, Artificial Sequence
  Synthetic
ccgttttttttttttgcattacc

SEQ ID NO: 20580 - DNA, 23 bp, Artificial Sequence
  Synthetic
ccgttttttttttttctatacaa

SEQ ID NO: 20581 - DNA, 23 bp, Artificial Sequence
  Synthetic
ccgttttttttttttctacacaa

SEQ ID NO: 20582 - DNA, 23 bp, Artificial Sequence
  Synthetic
ccgttttttttttttccatacaa

SEQ ID NO: 20583 - DNA, 23 bp, Artificial Sequence
  Synthetic
ccgttttttttttttctaaacaa

SEQ ID NO: 20584 - DNA, 23 bp, Artificial Sequence
  Synthetic
ccgttttttttttttatacaatc

SEQ ID NO: 20585 - DNA, 23 bp, Artificial Sequence
  Synthetic
ccgttttttttttttgtacaaac

SEQ ID NO: 20586 - DNA, 23 bp, Artificial Sequence
  Synthetic
ccgttttttttttttagcacaaa

SEQ ID NO: 20587 - DNA, 23 bp, Artificial Sequence
  Synthetic
ccgttttttttttttcaagttcg

SEQ ID NO: 20588 - DNA, 23 bp, Artificial Sequence
  Synthetic
ccgttttttttttttagttatca

SEQ ID NO: 20589 - DNA, 23 bp, Artificial Sequence
  Synthetic
ccgttttttttttttagccctgt

SEQ ID NO: 20590 - DNA, 23 bp, Artificial Sequence
  Synthetic
ccgttttttttttttcctgcact

SEQ ID NO: 20591 - DNA, 23 bp, Artificial Sequence
  Synthetic
ccgttttttttttttagccctgt

SEQ ID NO: 20592 - DNA, 23 bp, Artificial Sequence
  Synthetic
ccgttttttttttttcaaattcg

SEQ ID NO: 20593 - DNA, 23 bp, Artificial Sequence
  Synthetic
ccgttttttttttttaaattcgg

SEQ ID NO: 20594 - DNA, 23 bp, Artificial Sequence
  Synthetic
ccgttttttttttttaaattcga

SEQ ID NO: 20595 - DNA, 23 bp, Artificial Sequence
  Synthetic
ccgttttttttttttaaacacca

SEQ ID NO: 20596 - DNA, 23 bp, Artificial Sequence
  Synthetic
ccgttttttttttttcattcacc

SEQ ID NO: 20597 - DNA, 23 bp, Artificial Sequence
  Synthetic
ccgttttttttttttcaggttaa

SEQ ID NO: 20598 - DNA, 23 bp, Artificial Sequence
  Synthetic
ccgttttttttttttcaagttag

SEQ ID NO: 20599 - DNA, 23 bp, Artificial Sequence
  Synthetic
ccgttttttttttttattattac

SEQ ID NO: 20600 - DNA, 23 bp, Artificial Sequence
  Synthetic
ccgttttttttttttcgtaccaa

SEQ ID NO: 20601 - DNA, 23 bp, Artificial Sequence
  Synthetic
ccgttttttttttttaagagacc

SEQ ID NO: 20602 - DNA, 23 bp, Artificial Sequence
  Synthetic
ccgttttttttttttaagcccag

SEQ ID NO: 20603 - DNA, 23 bp, Artificial Sequence
  Synthetic
ccgttttttttttttccctttta

SEQ ID NO: 20604 - DNA, 23 bp, Artificial Sequence
  Synthetic
ccgttttttttttttccctttca

SEQ ID NO: 20605 - DNA, 23 bp, Artificial Sequence
  Synthetic
ccgttttttttttttccctttta

SEQ ID NO: 20606 - DNA, 23 bp, Artificial Sequence
  Synthetic
ccgttttttttttttaccatggc

SEQ ID NO: 20607 - DNA, 23 bp, Artificial Sequence
  Synthetic
ccgttttttttttttagctggtt

SEQ ID NO: 20608 - DNA, 23 bp, Artificial Sequence
  Synthetic
ccgttttttttttttctggttga

SEQ ID NO: 20609 - DNA, 23 bp, Artificial Sequence
  Synthetic
ccgttttttttttttagctggtt

SEQ ID NO: 20610 - DNA, 23 bp, Artificial Sequence
  Synthetic
ccgttttttttttttggctggtt

SEQ ID NO: 20611 - DNA, 23 bp, Artificial Sequence
  Synthetic
ccgttttttttttttcataggaa

SEQ ID NO: 20612 - DNA, 23 bp, Artificial Sequence
  Synthetic
ccgttttttttttttcgcgtatt

SEQ ID NO: 20613 - DNA, 23 bp, Artificial Sequence
  Synthetic
ccgttttttttttttcacaacac

SEQ ID NO: 20614 - DNA, 23 bp, Artificial Sequence
  Synthetic
ccgttttttttttttacacatgc

SEQ ID NO: 20615 - DNA, 23 bp, Artificial Sequence
  Synthetic
ccgttttttttttttccataggg

SEQ ID NO: 20616 - DNA, 23 bp, Artificial Sequence
  Synthetic
ccgttttttttttttataaagta

SEQ ID NO: 20617 - DNA, 23 bp, Artificial Sequence
  Synthetic
ccgttttttttttttgtgctttc

SEQ ID NO: 20618 - DNA, 23 bp, Artificial Sequence
  Synthetic
ccgttttttttttttagctacag

SEQ ID NO: 20619 - DNA, 23 bp, Artificial Sequence
  Synthetic
ccgttttttttttttacatcatc

SEQ ID NO: 20620 - DNA, 23 bp, Artificial Sequence
  Synthetic
ccgttttttttttttgggattcc

SEQ ID NO: 20621 - DNA, 23 bp, Artificial Sequence
  Synthetic
ccgttttttttttttcctatgga

SEQ ID NO: 20622 - DNA, 23 bp, Artificial Sequence
  Synthetic
ccgttttttttttttaaagttct

SEQ ID NO: 20623 - DNA, 23 bp, Artificial Sequence
  Synthetic
ccgttttttttttttaaagttct

SEQ ID NO: 20624 - DNA, 23 bp, Artificial Sequence
  Synthetic
ccgttttttttttttggtacaag

SEQ ID NO: 20625 - DNA, 23 bp, Artificial Sequence
  Synthetic
ccgttttttttttttcttttgtg

SEQ ID NO: 20626 - DNA, 23 bp, Artificial Sequence
  Synthetic
ccgttttttttttttcctatcac

SEQ ID NO: 20627 - DNA, 23 bp, Artificial Sequence
  Synthetic
ccgttttttttttttcaaaccat

SEQ ID NO: 20628 - DNA, 23 bp, Artificial Sequence
  Synthetic
ccgttttttttttttaaatcatg

SEQ ID NO: 20629 - DNA, 23 bp, Artificial Sequence
  Synthetic
ccgttttttttttttaaaccatg

SEQ ID NO: 20630 - DNA, 23 bp, Artificial Sequence
  Synthetic
ccgttttttttttttccaatatt

SEQ ID NO: 20631 - DNA, 23 bp, Artificial Sequence
  Synthetic
ccgttttttttttttccaatatt

SEQ ID NO: 20632 - DNA, 23 bp, Artificial Sequence
  Synthetic
ccgttttttttttttcagtattt

SEQ ID NO: 20633 - DNA, 23 bp, Artificial Sequence
  Synthetic
ccgttttttttttttaagtgcct

SEQ ID NO: 20634 - DNA, 23 bp, Artificial Sequence
  Synthetic
ccgttttttttttttacctgcac

SEQ ID NO: 20635 - DNA, 23 bp, Artificial Sequence
  Synthetic
ccgttttttttttttcaccgaca

SEQ ID NO: 20636 - DNA, 23 bp, Artificial Sequence
  Synthetic
ccgttttttttttttcagtcaac

SEQ ID NO: 20637 - DNA, 23 bp, Artificial Sequence
  Synthetic
ccgttttttttttttcaccgaca

SEQ ID NO: 20638 - DNA, 23 bp, Artificial Sequence
  Synthetic
ccgttttttttttttagttctac

SEQ ID NO: 20639 - DNA, 23 bp, Artificial Sequence
  Synthetic
ccgttttttttttttggcaagtc

SEQ ID NO: 20640 - DNA, 23 bp, Artificial Sequence
  Synthetic
ccgttttttttttttgtgaattc

SEQ ID NO: 20641 - DNA, 23 bp, Artificial Sequence
  Synthetic
ccgttttttttttttccttatca

SEQ ID NO: 20642 - DNA, 23 bp, Artificial Sequence
  Synthetic
ccgttttttttttttctgcaaca

SEQ ID NO: 20643 - DNA, 23 bp, Artificial Sequence
  Synthetic
ccgttttttttttttgatatcag

SEQ ID NO: 20644 - DNA, 23 bp, Artificial Sequence
  Synthetic
ccgttttttttttttgcactaga

SEQ ID NO: 20645 - DNA, 23 bp, Artificial Sequence
  Synthetic
ccgttttttttttttactgcact

SEQ ID NO: 20646 - DNA, 23 bp, Artificial Sequence
  Synthetic
ccgttttttttttttctgctttt

SEQ ID NO: 20647 - DNA, 23 bp, Artificial Sequence
  Synthetic
ccgttttttttttttctgtcaat

SEQ ID NO: 20648 - DNA, 23 bp, Artificial Sequence
  Synthetic
ccgttttttttttttagcgggac

SEQ ID NO: 20649 - DNA, 23 bp, Artificial Sequence
  Synthetic
ccgttttttttttttacatggag

SEQ ID NO: 20650 - DNA, 23 bp, Artificial Sequence
  Synthetic
ccgttttttttttttaacaacat

SEQ ID NO: 20651 - DNA, 23 bp, Artificial Sequence
  Synthetic
ccgttttttttttttaacaacat

SEQ ID NO: 20652 - DNA, 23 bp, Artificial Sequence
  Synthetic
ccgttttttttttttacaggtag

SEQ ID NO: 20653 - DNA, 23 bp, Artificial Sequence
  Synthetic
ccgttttttttttttccaatgtg

SEQ ID NO: 20654 - DNA, 23 bp, Artificial Sequence
  Synthetic
ccgttttttttttttacacgtag

SEQ ID NO: 20655 - DNA, 23 bp, Artificial Sequence
  Synthetic
ccgttttttttttttgttttgca

SEQ ID NO: 20656 - DNA, 23 bp, Artificial Sequence
  Synthetic
ccgttttttttttttgttttgca

SEQ ID NO: 20657 - DNA, 23 bp, Artificial Sequence
  Synthetic
ccgttttttttttttatacttct

SEQ ID NO: 20658 - DNA, 23 bp, Artificial Sequence
  Synthetic
ccgttttttttttttatacttct

SEQ ID NO: 20659 - DNA, 23 bp, Artificial Sequence
  Synthetic
ccgttttttttttttatcgttac

SEQ ID NO: 20660 - DNA, 23 bp, Artificial Sequence
  Synthetic
ccgttttttttttttatcattac

SEQ ID NO: 20661 - DNA, 23 bp, Artificial Sequence
  Synthetic
ccgttttttttttttcatgccct

SEQ ID NO: 20662 - DNA, 23 bp, Artificial Sequence
  Synthetic
ccgttttttttttttagaggtat

SEQ ID NO: 20663 - DNA, 23 bp, Artificial Sequence
  Synthetic
ccgttttttttttttagtggtcc

SEQ ID NO: 20664 - DNA, 23 bp, Artificial Sequence
  Synthetic
ccgttttttttttttgcatagga

SEQ ID NO: 20665 - DNA, 23 bp, Artificial Sequence
  Synthetic
ccgttttttttttttgactccgg

SEQ ID NO: 20666 - DNA, 23 bp, Artificial Sequence
  Synthetic
ccgttttttttttttggatccgg

SEQ ID NO: 20667 - DNA, 23 bp, Artificial Sequence
  Synthetic
ccgttttttttttttacacactt

SEQ ID NO: 20668 - DNA, 23 bp, Artificial Sequence
  Synthetic
ccgttttttttttttaagcttta

SEQ ID NO: 20669 - DNA, 23 bp, Artificial Sequence
  Synthetic
ccgttttttttttttcctgcact

SEQ ID NO: 20670 - DNA, 23 bp, Artificial Sequence
  Synthetic
ccgttttttttttttgtgctcat

SEQ ID NO: 20671 - DNA, 23 bp, Artificial Sequence
  Synthetic
ccgttttttttttttcctgcact

SEQ ID NO: 20672 - DNA, 23 bp, Artificial Sequence
  Synthetic
ccgttttttttttttccgctgtc

SEQ ID NO: 20673 - DNA, 23 bp, Artificial Sequence
  Synthetic
ccgttttttttttttccatgact

SEQ ID NO: 20674 - DNA, 23 bp, Artificial Sequence
  Synthetic
ccgttttttttttttcctgtctg

SEQ ID NO: 20675 - DNA, 23 bp, Artificial Sequence
  Synthetic
ccgttttttttttttctgtcatt

SEQ ID NO: 20676 - DNA, 23 bp, Artificial Sequence
  Synthetic
ccgttttttttttttcagttgcc

SEQ ID NO: 20677 - DNA, 23 bp, Artificial Sequence
  Synthetic
ccgttttttttttttcaatcagt

SEQ ID NO: 20678 - DNA, 23 bp, Artificial Sequence
  Synthetic
ccgttttttttttttatggttag

SEQ ID NO: 20679 - DNA, 23 bp, Artificial Sequence
  Synthetic
ccgttttttttttttaattgcgt

SEQ ID NO: 20680 - DNA, 23 bp, Artificial Sequence
  Synthetic
ccgttttttttttttagttcttc

SEQ ID NO: 20681 - DNA, 23 bp, Artificial Sequence
  Synthetic
ccgttttttttttttagcttgcc

SEQ ID NO: 20682 - DNA, 23 bp, Artificial Sequence
  Synthetic
ccgttttttttttttaacccagc

SEQ ID NO: 20683 - DNA, 23 bp, Artificial Sequence
  Synthetic
ccgttttttttttttgacccagt

SEQ ID NO: 20684 - DNA, 23 bp, Artificial Sequence
  Synthetic
ccgttttttttttttggtatttg

SEQ ID NO: 20685 - DNA, 23 bp, Artificial Sequence
  Synthetic
ccgttttttttttttaaatccct

SEQ ID NO: 20686 - DNA, 23 bp, Artificial Sequence
  Synthetic
ccgttttttttttttaatccctg

SEQ ID NO: 20687 - DNA, 23 bp, Artificial Sequence
  Synthetic
ccgttttttttttttcctgctga

SEQ ID NO: 20688 - DNA, 23 bp, Artificial Sequence
  Synthetic
ccgttttttttttttcctgctga

SEQ ID NO: 20689 - DNA, 23 bp, Artificial Sequence
  Synthetic
ccgttttttttttttgaccgaga

SEQ ID NO: 20690 - DNA, 23 bp, Artificial Sequence
  Synthetic
ccgttttttttttttctatcctg

SEQ ID NO: 20691 - DNA, 23 bp, Artificial Sequence
  Synthetic
ccgttttttttttttggaactta

SEQ ID NO: 20692 - DNA, 23 bp, Artificial Sequence
  Synthetic
ccgttttttttttttagaactta

SEQ ID NO: 20693 - DNA, 23 bp, Artificial Sequence
  Synthetic
ccgttttttttttttgaacttag

SEQ ID NO: 20694 - DNA, 23 bp, Artificial Sequence
  Synthetic
ccgttttttttttttccgatttc

SEQ ID NO: 20695 - DNA, 23 bp, Artificial Sequence
  Synthetic
ccgttttttttttttcactgatt

SEQ ID NO: 20696 - DNA, 23 bp, Artificial Sequence
  Synthetic
ccgttttttttttttcgatttca

SEQ ID NO: 20697 - DNA, 23 bp, Artificial Sequence
  Synthetic
ccgttttttttttttacaccaag

SEQ ID NO: 20698 - DNA, 23 bp, Artificial Sequence
  Synthetic
ccgttttttttttttcactgatt

SEQ ID NO: 20699 - DNA, 23 bp, Artificial Sequence
  Synthetic
ccgttttttttttttgacaatac

SEQ ID NO: 20700 - DNA, 23 bp, Artificial Sequence
  Synthetic
ccgttttttttttttactaaaac

SEQ ID NO: 20701 - DNA, 23 bp, Artificial Sequence
  Synthetic
ccgttttttttttttgcaaacat

SEQ ID NO: 20702 - DNA, 23 bp, Artificial Sequence
  Synthetic
ccgttttttttttttcagtcgag

SEQ ID NO: 20703 - DNA, 23 bp, Artificial Sequence
  Synthetic
ccgttttttttttttctgagtgt

SEQ ID NO: 20704 - DNA, 23 bp, Artificial Sequence
  Synthetic
ccgttttttttttttgagagtgt

SEQ ID NO: 20705 - DNA, 23 bp, Artificial Sequence
  Synthetic
ccgttttttttttttcagtcggg

SEQ ID NO: 20706 - DNA, 23 bp, Artificial Sequence
  Synthetic
ccgttttttttttttagtcaagg

SEQ ID NO: 20707 - DNA, 23 bp, Artificial Sequence
  Synthetic
ccgttttttttttttgctatgcc

SEQ ID NO: 20708 - DNA, 23 bp, Artificial Sequence
  Synthetic
ccgttttttttttttacaaaatc

SEQ ID NO: 20709 - DNA, 23 bp, Artificial Sequence
  Synthetic
ccgttttttttttttatgcaact

SEQ ID NO: 20710 - DNA, 23 bp, Artificial Sequence
  Synthetic
ccgttttttttttttatgcaaca

SEQ ID NO: 20711 - DNA, 23 bp, Artificial Sequence
  Synthetic
ccgttttttttttttcaaccagc

SEQ ID NO: 20712 - DNA, 23 bp, Artificial Sequence
  Synthetic
ccgttttttttttttatcagcta

SEQ ID NO: 20713 - DNA, 23 bp, Artificial Sequence
  Synthetic
ccgttttttttttttagatggat

SEQ ID NO: 20714 - DNA, 23 bp, Artificial Sequence
  Synthetic
ccgttttttttttttattgcatc

SEQ ID NO: 20715 - DNA, 23 bp, Artificial Sequence
  Synthetic
ccgttttttttttttaggatttt

SEQ ID NO: 20716 - DNA, 23 bp, Artificial Sequence
  Synthetic
ccgttttttttttttccattgct

SEQ ID NO: 20717 - DNA, 23 bp, Artificial Sequence
  Synthetic
ccgttttttttttttccacaatc

SEQ ID NO: 20718 - DNA, 23 bp, Artificial Sequence
  Synthetic
ccgttttttttttttacgggagt

SEQ ID NO: 20719 - DNA, 23 bp, Artificial Sequence
  Synthetic
ccgttttttttttttaccgaact

SEQ ID NO: 20720 - DNA, 23 bp, Artificial Sequence
  Synthetic
ccgttttttttttttggcattac

SEQ ID NO: 20721 - DNA, 23 bp, Artificial Sequence
  Synthetic
ccgttttttttttttcagctaac

SEQ ID NO: 20722 - DNA, 23 bp, Artificial Sequence
  Synthetic
ccgttttttttttttctcagtaa

SEQ ID NO: 20723 - DNA, 23 bp, Artificial Sequence
  Synthetic
ccgttttttttttttatgtagtc

SEQ ID NO: 20724 - DNA, 23 bp, Artificial Sequence
  Synthetic
ccgttttttttttttagccgtac

SEQ ID NO: 20725 - DNA, 23 bp, Artificial Sequence
  Synthetic
ccgttttttttttttaacatcac

SEQ ID NO: 20726 - DNA, 23 bp, Artificial Sequence
  Synthetic
ccgttttttttttttacaaaatc

SEQ ID NO: 20727 - DNA, 23 bp, Artificial Sequence
  Synthetic
ccgttttttttttttacagctag

SEQ ID NO: 20728 - DNA, 23 bp, Artificial Sequence
  Synthetic
ccgttttttttttttcggttatc

SEQ ID NO: 20729 - DNA, 23 bp, Artificial Sequence
  Synthetic
ccgttttttttttttggccggga

SEQ ID NO: 20730 - DNA, 23 bp, Artificial Sequence
  Synthetic
ccgttttttttttttggccggga

SEQ ID NO: 20731 - DNA, 23 bp, Artificial Sequence
  Synthetic
ccgttttttttttttcctgcacg

SEQ ID NO: 20732 - DNA, 23 bp, Artificial Sequence
  Synthetic
ccgttttttttttttcctgcacg

SEQ ID NO: 20733 - DNA, 23 bp, Artificial Sequence
  Synthetic
ccgttttttttttttcaaaaatg

SEQ ID NO: 20734 - DNA, 23 bp, Artificial Sequence
  Synthetic
ccgttttttttttttcaatacaa

SEQ ID NO: 20735 - DNA, 23 bp, Artificial Sequence
  Synthetic
ccgttttttttttttcaagatcg

SEQ ID NO: 20736 - DNA, 23 bp, Artificial Sequence
  Synthetic
ccgttttttttttttacagctag

SEQ ID NO: 20737 - DNA, 23 bp, Artificial Sequence
  Synthetic
ccgttttttttttttcggttatc

SEQ ID NO: 20738 - DNA, 23 bp, Artificial Sequence
  Synthetic
ccgttttttttttttacagctag

SEQ ID NO: 20739 - DNA, 23 bp, Artificial Sequence
  Synthetic
ccgttttttttttttgttcggtt

SEQ ID NO: 20740 - DNA, 23 bp, Artificial Sequence
  Synthetic
ccgttttttttttttctcactct

SEQ ID NO: 20741 - DNA, 23 bp, Artificial Sequence
  Synthetic
ccgttttttttttttctcactct

SEQ ID NO: 20742 - DNA, 23 bp, Artificial Sequence
  Synthetic
ccgttttttttttttctcactct

SEQ ID NO: 20743 - DNA, 23 bp, Artificial Sequence
  Synthetic
ccgttttttttttttctcactct

SEQ ID NO: 20744 - DNA, 23 bp, Artificial Sequence
  Synthetic
ccgttttttttttttctcactct

SEQ ID NO: 20745 - DNA, 23 bp, Artificial Sequence
  Synthetic
ccgttttttttttttctcactct

SEQ ID NO: 20746 - DNA, 23 bp, Artificial Sequence
  Synthetic
ccgttttttttttttctcactct

SEQ ID NO: 20747 - DNA, 23 bp, Artificial Sequence
  Synthetic
ccgttttttttttttctcactct

SEQ ID NO: 20748 - DNA, 23 bp, Artificial Sequence
  Synthetic
ccgttttttttttttctcactct

SEQ ID NO: 20749 - DNA, 23 bp, Artificial Sequence
  Synthetic
ccgttttttttttttctctctct

SEQ ID NO: 20750 - DNA, 23 bp, Artificial Sequence
  Synthetic
ccgttttttttttttctcgctct

SEQ ID NO: 20751 - DNA, 23 bp, Artificial Sequence
  Synthetic
ccgttttttttttttgagctccc

SEQ ID NO: 20752 - DNA, 23 bp, Artificial Sequence
  Synthetic
ccgttttttttttttgagctccc

SEQ ID NO: 20753 - DNA, 23 bp, Artificial Sequence
  Synthetic
ccgttttttttttttgagctccc

SEQ ID NO: 20754 - DNA, 23 bp, Artificial Sequence
  Synthetic
ccgttttttttttttgagctccc

SEQ ID NO: 20755 - DNA, 23 bp, Artificial Sequence
  Synthetic
ccgttttttttttttcatacagg

SEQ ID NO: 20756 - DNA, 23 bp, Artificial Sequence
  Synthetic
ccgttttttttttttcatacagg

SEQ ID NO: 20757 - DNA, 23 bp, Artificial Sequence
  Synthetic
ccgttttttttttttcatacagg

SEQ ID NO: 20758 - DNA, 23 bp, Artificial Sequence
  Synthetic
ccgttttttttttttcatacagg

SEQ ID NO: 20759 - DNA, 23 bp, Artificial Sequence
  Synthetic
ccgttttttttttttcatacagg

SEQ ID NO: 20760 - DNA, 23 bp, Artificial Sequence
  Synthetic
ccgttttttttttttgcatacag

SEQ ID NO: 20761 - DNA, 23 bp, Artificial Sequence
  Synthetic
ccgttttttttttttatgcagag

SEQ ID NO: 20762 - DNA, 23 bp, Artificial Sequence
  Synthetic
ccgttttttttttttacgtgccc

SEQ ID NO: 20763 - DNA, 23 bp, Artificial Sequence
  Synthetic
ccgttttttttttttacgtgccc

SEQ ID NO: 20764 - DNA, 23 bp, Artificial Sequence
  Synthetic
ccgttttttttttttacgtgccc

SEQ ID NO: 20765 - DNA, 23 bp, Artificial Sequence
  Synthetic
ccgttttttttttttacgtgccc

SEQ ID NO: 20766 - DNA, 23 bp, Artificial Sequence
  Synthetic
ccgttttttttttttggaatgaa

SEQ ID NO: 20767 - DNA, 23 bp, Artificial Sequence
  Synthetic
ccgttttttttttttgaatgaag

SEQ ID NO: 20768 - DNA, 23 bp, Artificial Sequence
  Synthetic
ccgttttttttttttgaatgaag

SEQ ID NO: 20769 - DNA, 23 bp, Artificial Sequence
  Synthetic
ccgttttttttttttgaatgaag

SEQ ID NO: 20770 - DNA, 23 bp, Artificial Sequence
  Synthetic
ccgttttttttttttgaatgaag

SEQ ID NO: 20771 - DNA, 23 bp, Artificial Sequence
  Synthetic
ccgttttttttttttgaatgaag

SEQ ID NO: 20772 - DNA, 23 bp, Artificial Sequence
  Synthetic
ccgttttttttttttgaatgaag

SEQ ID NO: 20773 - DNA, 23 bp, Artificial Sequence
  Synthetic
ccgttttttttttttgaatgaag

SEQ ID NO: 20774 - DNA, 23 bp, Artificial Sequence
  Synthetic
ccgttttttttttttgaatgaag

SEQ ID NO: 20775 - DNA, 23 bp, Artificial Sequence
  Synthetic
ccgttttttttttttggattgaa

SEQ ID NO: 20776 - DNA, 23 bp, Artificial Sequence
  Synthetic
ccgttttttttttttggattgaa

SEQ ID NO: 20777 - DNA, 23 bp, Artificial Sequence
  Synthetic
ccgttttttttttttggaatgaa

SEQ ID NO: 20778 - DNA, 23 bp, Artificial Sequence
  Synthetic
ccgttttttttttttggaatgaa

SEQ ID NO: 20779 - DNA, 23 bp, Artificial Sequence
  Synthetic
ccgttttttttttttatcatgct

SEQ ID NO: 20780 - DNA, 23 bp, Artificial Sequence
  Synthetic
ccgttttttttttttatcatgct

SEQ ID NO: 20781 - DNA, 23 bp, Artificial Sequence
  Synthetic
ccgttttttttttttatcatgct

SEQ ID NO: 20782 - DNA, 23 bp, Artificial Sequence
  Synthetic
ccgttttttttttttatcatgct

SEQ ID NO: 20783 - DNA, 23 bp, Artificial Sequence
  Synthetic
ccgttttttttttttgatcatgc

SEQ ID NO: 20784 - DNA, 23 bp, Artificial Sequence
  Synthetic
ccgttttttttttttgatcatgc

SEQ ID NO: 20785 - DNA, 23 bp, Artificial Sequence
  Synthetic
ccgttttttttttttgatcatgc

SEQ ID NO: 20786 - DNA, 23 bp, Artificial Sequence
  Synthetic
ccgttttttttttttgatcatgc

SEQ ID NO: 20787 - DNA, 23 bp, Artificial Sequence
  Synthetic
ccgttttttttttttgatcatgc

SEQ ID NO: 20788 - DNA, 23 bp, Artificial Sequence
  Synthetic
ccgttttttttttttccgatctg

SEQ ID NO: 20789 - DNA, 23 bp, Artificial Sequence
  Synthetic
ccgttttttttttttccgatctg

SEQ ID NO: 20790 - DNA, 23 bp, Artificial Sequence
  Synthetic
ccgttttttttttttgcaagtca

SEQ ID NO: 20791 - DNA, 23 bp, Artificial Sequence
  Synthetic
ccgttttttttttttgcaagtca

SEQ ID NO: 20792 - DNA, 23 bp, Artificial Sequence
  Synthetic
ccgttttttttttttggcaagtc

SEQ ID NO: 20793 - DNA, 23 bp, Artificial Sequence
  Synthetic
ccgttttttttttttaggcagtc

SEQ ID NO: 20794 - DNA, 23 bp, Artificial Sequence
  Synthetic
ccgttttttttttttaggcagtc

SEQ ID NO: 20795 - DNA, 23 bp, Artificial Sequence
  Synthetic
ccgttttttttttttgcaagtca

SEQ ID NO: 20796 - DNA, 23 bp, Artificial Sequence
  Synthetic
ccgttttttttttttgcaagtca

SEQ ID NO: 20797 - DNA, 23 bp, Artificial Sequence
  Synthetic
ccgttttttttttttgcaagtca

SEQ ID NO: 20798 - DNA, 23 bp, Artificial Sequence
  Synthetic
ccgttttttttttttggcaagtc

SEQ ID NO: 20799 - DNA, 23 bp, Artificial Sequence
  Synthetic
ccgttttttttttttggcaagtc

SEQ ID NO: 20800 - DNA, 23 bp, Artificial Sequence
  Synthetic
ccgttttttttttttggcaagtc

SEQ ID NO: 20801 - DNA, 23 bp, Artificial Sequence
  Synthetic
ccgttttttttttttggcgcggc

SEQ ID NO: 20802 - DNA, 23 bp, Artificial Sequence
  Synthetic
ccgttttttttttttatattggc

SEQ ID NO: 20803 - DNA, 23 bp, Artificial Sequence
  Synthetic
ccgttttttttttttattggcac

SEQ ID NO: 20804 - DNA, 23 bp, Artificial Sequence
  Synthetic
ccgttttttttttttattggcac

SEQ ID NO: 20805 - DNA, 23 bp, Artificial Sequence
  Synthetic
ccgttttttttttttattggcac

SEQ ID NO: 20806 - DNA, 23 bp, Artificial Sequence
  Synthetic
ccgttttttttttttatattggc

SEQ ID NO: 20807 - DNA, 23 bp, Artificial Sequence
  Synthetic
ccgttttttttttttattggctc

SEQ ID NO: 20808 - DNA, 23 bp, Artificial Sequence
  Synthetic
ccgttttttttttttgatattgg

SEQ ID NO: 20809 - DNA, 23 bp, Artificial Sequence
  Synthetic
ccgttttttttttttattggcac

SEQ ID NO: 20810 - DNA, 23 bp, Artificial Sequence
  Synthetic
ccgttttttttttttattggcac

SEQ ID NO: 20811 - DNA, 23 bp, Artificial Sequence
  Synthetic
ccgttttttttttttgatattgg

SEQ ID NO: 20812 - DNA, 23 bp, Artificial Sequence
  Synthetic
ccgttttttttttttagcatcat

SEQ ID NO: 20813 - DNA, 23 bp, Artificial Sequence
  Synthetic
ccgttttttttttttagcatcat

SEQ ID NO: 20814 - DNA, 23 bp, Artificial Sequence
  Synthetic
ccgttttttttttttagcatcat

SEQ ID NO: 20815 - DNA, 23 bp, Artificial Sequence
  Synthetic
ccgttttttttttttagcatcat

SEQ ID NO: 20816 - DNA, 23 bp, Artificial Sequence
  Synthetic
ccgttttttttttttcagcatca

SEQ ID NO: 20817 - DNA, 23 bp, Artificial Sequence
  Synthetic
ccgttttttttttttgagcaccc

SEQ ID NO: 20818 - DNA, 23 bp, Artificial Sequence
  Synthetic
ccgttttttttttttgagcaccc

SEQ ID NO: 20819 - DNA, 23 bp, Artificial Sequence
  Synthetic
ccgttttttttttttgagcaccc

SEQ ID NO: 20820 - DNA, 23 bp, Artificial Sequence
  Synthetic
ccgttttttttttttgagcaccc

SEQ ID NO: 20821 - DNA, 23 bp, Artificial Sequence
  Synthetic
ccgttttttttttttatcaatgc

SEQ ID NO: 20822 - DNA, 23 bp, Artificial Sequence
  Synthetic
ccgttttttttttttaggtggac

SEQ ID NO: 20823 - DNA, 23 bp, Artificial Sequence
  Synthetic
ccgttttttttttttaggtggac

SEQ ID NO: 20824 - DNA, 23 bp, Artificial Sequence
  Synthetic
ccgttttttttttttgttccccc

SEQ ID NO: 20825 - DNA, 23 bp, Artificial Sequence
  Synthetic
ccgttttttttttttgttccccc

SEQ ID NO: 20826 - DNA, 23 bp, Artificial Sequence
  Synthetic
ccgttttttttttttgttcctcc

SEQ ID NO: 20827 - DNA, 23 bp, Artificial Sequence
  Synthetic
ccgttttttttttttgttcaaga

SEQ ID NO: 20828 - DNA, 23 bp, Artificial Sequence
  Synthetic
ccgttttttttttttgttcaaga

SEQ ID NO: 20829 - DNA, 23 bp, Artificial Sequence
  Synthetic
ccgttttttttttttgggcaatt

SEQ ID NO: 20830 - DNA, 23 bp, Artificial Sequence
  Synthetic
ccgttttttttttttggacagct

SEQ ID NO: 20831 - DNA, 23 bp, Artificial Sequence
  Synthetic
ccgttttttttttttgggcaatt

SEQ ID NO: 20832 - DNA, 23 bp, Artificial Sequence
  Synthetic
ccgttttttttttttgggcagct

SEQ ID NO: 20833 - DNA, 23 bp, Artificial Sequence
  Synthetic
ccgttttttttttttgggcaact

SEQ ID NO: 20834 - DNA, 23 bp, Artificial Sequence
  Synthetic
ccgttttttttttttgggcaaat

SEQ ID NO: 20835 - DNA, 23 bp, Artificial Sequence
  Synthetic
ccgttttttttttttcagggaag

SEQ ID NO: 20836 - DNA, 46 bp, Artificial Sequence
  Synthetic
  misc_feature (46)..(46): n is a, c, g or t
  misc_feature (45)..(45): v is a, c or g
gcgagcacagaattaatacgactcactacccgttttttttttttvn

SEQ ID NO: 20837 - DNA, 46 bp, Artificial Sequence
  Synthetic
  misc_feature (46)..(46): n is a, c, g or t
  misc_feature (45)..(45): v is a, c or g
gcgagcacagaattaatacgactcactatcggttttttttttttvn

SEQ ID NO: 20838 - DNA, 14 bp, Artificial Sequence
  Synthetic
acactccagctggg

SEQ ID NO: 20839 - DNA, 12 bp, Artificial Sequence
  Synthetic
cagtcatttggg

SEQ ID NO: 20840 - RNA, 22 nt, Homo sapiens
ugagguaguagguuguauaguu

SEQ ID NO: 20841 - RNA, 22 nt, Homo sapiens
ugagguaguagguuguaugguu

SEQ ID NO: 20842 - RNA, 21 nt, Homo sapiens
agagguaguagguugcauagu

SEQ ID NO: 20843 - RNA, 22 nt, Homo sapiens
aacccguagauccgaucuugug

SEQ ID NO: 20844 - RNA, 22 nt, Homo sapiens
aacccguagauccgaacuugug

SEQ ID NO: 20845 - DNA, 15 bp, Artificial Sequence
  Synthetic
ccgtttttttttttt

SEQ ID NO: 20846 - DNA, 23 bp, Artificial Sequence
  Synthetic
ccgttttttttttttaactatac

SEQ ID NO: 20847 - DNA, 23 bp, Artificial Sequence
  Synthetic
ccgttttttttttttactataca

SEQ ID NO: 20848 - DNA, 23 bp, Artificial Sequence
  Synthetic
ccgttttttttttttctatacaa

SEQ ID NO: 20849 - RNA, 23 nt, Homo sapiens
ugauugguacgucuguggguaga

SEQ ID NO: 20850 - DNA, 23 bp, Artificial Sequence
  Synthetic
ccgttttttttttttctacccac

SEQ ID NO: 20851 - DNA, 23 bp, Artificial Sequence
  Synthetic
ccgttttttttttttacccacag

SEQ ID NO: 20852 - DNA, 23 bp, Artificial Sequence
  Synthetic
ccgttttttttttttcccacaga

SEQ ID NO: 20853 - DNA, 44 bp, Artificial Sequence
  Synthetic
  misc_feature (44)..(44): n is a, c, g or t
  misc_feature (43)..(43): v is a, c or g
gcgagcacagaattaatacgactcactacccgttttttttttvn

SEQ ID NO: 20854 - DNA, 46 bp, Artificial Sequence
  Synthetic
  misc_feature (46)..(46): n is a, c, g or t
  misc_feature (45)..(45): v is a, c or g
gcgagcacagaattaatacgactcactatccgttttttttttttvn

SEQ ID NO: 20855 - DNA, 46 bp, Artificial Sequence
  Synthetic
  misc_feature (46)..(46): n is a, c, g or t
  misc_feature (45)..(45): v is a, c or g
gcgagcacagaattaatacgactcactatcccttttttttttttvn

SEQ ID NO: 20856 - DNA, 46 bp, Artificial Sequence
  Synthetic
  misc_feature (46)..(46): n is a, c, g or t
  misc_feature (45)..(45): v is a, c or g
gcgagcacagaattaatacgactcactatccgtttttattttttvn

SEQ ID NO: 20857 - DNA, 46 bp, Artificial Sequence
  Synthetic
  misc_feature (46)..(46): n is a, c, g or t
  misc_feature (45)..(45): v is a, c or g
gcgagcacagaattaatacgactcactataggttttttttttttvn

SEQ ID NO: 20858 - DNA, 46 bp, Artificial Sequence
  Synthetic
  misc_feature (46)..(46): n is a, c, g or t
  misc_feature (45)..(45): v is a, c or g
gcgagcacagaattaatacgactcactatccgatttttttttttvn

SEQ ID NO: 20859 - DNA, 22 bp, Artificial Sequence
  Synthetic
gcgagcacagaattaatacgac

SEQ ID NO: 20860 - DNA, 21 bp, Artificial Sequence
  Synthetic
ccgttttttttttaactatac

SEQ ID NO: 20861 - DNA, 21 bp, Artificial Sequence
  Synthetic
ccgttttttttttaaccatac

SEQ ID NO: 20862 - DNA, 44 bp, Artificial Sequence
  Synthetic
  misc_feature (44)..(44): n is a, c, g or t
  misc_feature (43)..(43): v is a, c or g
gcgagcacagaattaatacgactcactatcggttttttttttvn

SEQ ID NO: 20863 - DNA, 21 bp, Homo sapiens
tggaatgtaaagaagtatgta

SEQ ID NO: 20864 - DNA, 22 bp, Homo sapiens
aacccgtagatccgaacttgtg

SEQ ID NO: 20865 - DNA, 22 bp, Homo sapiens
tacagtactgtgataactgaag

SEQ ID NO: 20866 - DNA, 23 bp, Homo sapiens
agcagcattgtacagggctatga

SEQ ID NO: 20867 - DNA, 20 bp, Homo sapiens
tcaaatgctcagactcctgt

SEQ ID NO: 20868 - DNA, 24 bp, Homo sapiens
aaaagtgcttacagtgcaggtagc

SEQ ID NO: 20869 - DNA, 21 bp, Homo sapiens
taaagtgctgacagtgcagat

SEQ ID NO: 20870 - DNA, 23 bp, Homo sapiens
agcagcattgtacagggctatca

SEQ ID NO: 20871 - DNA, 23 bp, Homo sapiens
taccctgtagatccgaatttgtg

SEQ ID NO: 20872 - DNA, 22 bp, Homo sapiens
taccctgtagaaccgaatttgt

SEQ ID NO: 20873 - DNA, 23 bp, Homo sapiens
tggagtgtgacaatggtgtttgt

SEQ ID NO: 20874 - DNA, 22 bp, Homo sapiens
ttaaggcacgcggtgaatgcca

SEQ ID NO: 20875 - DNA, 23 bp, Homo sapiens
tccctgagaccctttaacctgtg

SEQ ID NO: 20876 - DNA, 22 bp, Homo sapiens
tccctgagaccctaacttgtga

SEQ ID NO: 20877 - DNA, 21 bp, Homo sapiens
cattattacttttggtacgcg

SEQ ID NO: 20878 - DNA, 21 bp, Homo sapiens
tcgtaccgtgagtaataatgc

SEQ ID NO: 20879 - DNA, 22 bp, Homo sapiens
tcacagtgaaccggtctctttt

SEQ ID NO: 20880 - DNA, 22 bp, Homo sapiens
tcacagtgaaccggtctctttc

SEQ ID NO: 20881 - DNA, 21 bp, Homo sapiens
ctttttgcggtctgggcttgc

SEQ ID NO: 20882 - DNA, 22 bp, Homo sapiens
cagtgcaatgttaaaagggcat

SEQ ID NO: 20883 - DNA, 22 bp, Homo sapiens
cagtgcaatgatgaaagggcat

SEQ ID NO: 20884 - DNA, 22 bp, Homo sapiens
taacagtctacagccatggtcg

SEQ ID NO: 20885 - DNA, 22 bp, Homo sapiens
ttggtccccttcaaccagctgt

SEQ ID NO: 20886 - DNA, 21 bp, Homo sapiens
ttggtccccttcaaccagcta

SEQ ID NO: 20887 - DNA, 21 bp, Homo sapiens
tgtgactggttgaccagaggg

SEQ ID NO: 20888 - DNA, 23 bp, Homo sapiens
tatggctttttattcctatgtga

SEQ ID NO: 20889 - DNA, 22 bp, Homo sapiens
tatggcttttcattcctatgtg

SEQ ID NO: 20890 - DNA, 23 bp, Homo sapiens
actccatttgttttgatgatgga

SEQ ID NO: 20891 - DNA, 22 bp, Homo sapiens
tattgcttaagaatacgcgtag

SEQ ID NO: 20892 - DNA, 17 bp, Homo sapiens
agctggtgttgtgaatc

SEQ ID NO: 20893 - DNA, 18 bp, Homo sapiens
tctacagtgcacgtgtct

SEQ ID NO: 20894 - DNA, 21 bp, Homo sapiens
agtggttttaccctatggtag

SEQ ID NO: 20895 - DNA, 22 bp, Homo sapiens
taacactgtctggtaaagatgg

SEQ ID NO: 20896 - DNA, 23 bp, Homo sapiens
tgtagtgtttcctactttatgga

SEQ ID NO: 20897 - DNA, 20 bp, Homo sapiens
cataaagtagaaagcactac

SEQ ID NO: 20898 - DNA, 22 bp, Homo sapiens
tgagatgaagcactgtagctca

SEQ ID NO: 20899 - DNA, 22 bp, Homo sapiens
tacagtatagatgatgtactag

SEQ ID NO: 20900 - DNA, 24 bp, Homo sapiens
gtccagttttcccaggaatccctt

SEQ ID NO: 20901 - DNA, 22 bp, Homo sapiens
tgagaactgaattccatgggtt

SEQ ID NO: 20902 - DNA, 22 bp, Homo sapiens
tgagaactgaattccataggct

SEQ ID NO: 20903 - DNA, 20 bp, Homo sapiens
gtgtgtggaaatgcttctgc

SEQ ID NO: 20904 - DNA, 22 bp, Homo sapiens
tcagtgcactacagaactttgt

SEQ ID NO: 20905 - DNA, 22 bp, Homo sapiens
tcagtgcatcacagaactttgt

SEQ ID NO: 20906 - DNA, 22 bp, Homo sapiens
tctggctccgtgtcttcactcc

SEQ ID NO: 20907 - DNA, 22 bp, Homo sapiens
tctcccaacccttgtaccagtg

SEQ ID NO: 20908 - DNA, 22 bp, Homo sapiens
actagactgaagctccttgagg

SEQ ID NO: 20909 - DNA, 22 bp, Homo sapiens
tcagtgcatgacagaacttggg

SEQ ID NO: 20910 - DNA, 20 bp, Homo sapiens
ttgcatagtcacaaaagtga

SEQ ID NO: 20911 - DNA, 22 bp, Homo sapiens
aatcatacacggttgacctatt

SEQ ID NO: 20912 - DNA, 22 bp, Homo sapiens
taggttatccgtgttgccttcg

SEQ ID NO: 20913 - DNA, 22 bp, Homo sapiens
ttaatgctaatcgtgatagggg

SEQ ID NO: 20914 - DNA, 22 bp, Homo sapiens
tagcagcacataatggtttgtg

SEQ ID NO: 20915 - DNA, 22 bp, Homo sapiens
tagcagcacatcatggtttaca

SEQ ID NO: 20916 - DNA, 22 bp, Homo sapiens
tagcagcacgtaaatattggcg

SEQ ID NO: 20917 - DNA, 20 bp, Homo sapiens
actgcagtgaaggcacttgt

SEQ ID NO: 20918 - DNA, 24 bp, Homo sapiens
caaagtgcttacagtgcaggtagt

SEQ ID NO: 20919 - DNA, 23 bp, Homo sapiens
aacattcaacgctgtcggtgagt

SEQ ID NO: 20920 - DNA, 22 bp, Homo sapiens
aacattcattgctgtcggtggg

SEQ ID NO: 20921 - DNA, 22 bp, Homo sapiens
aacattcaacctgtcggtgagt

SEQ ID NO: 20922 - DNA, 24 bp, Homo sapiens
aacattcattgttgtcggtgggtt

SEQ ID NO: 20923 - DNA, 21 bp, Homo sapiens
tggttctagacttgccaacta

SEQ ID NO: 20924 - DNA, 22 bp, Homo sapiens
tttggcaatggtagaactcaca

SEQ ID NO: 20925 - DNA, 23 bp, Homo sapiens
tatggcactggtagaattcactg

SEQ ID NO: 20926 - DNA, 39 bp, Homo sapiens
tcagaacgtgacaatcagcactagctattgcttgctatt

SEQ ID NO: 20927 - DNA, 38 bp, Homo sapiens
cagtgaagcaatggcaatactagctattgcttgctatt

SEQ ID NO: 20928 - DNA, 39 bp, Homo sapiens
tgcatcagcgatcttggtggttagctattgcttgctatt

SEQ ID NO: 20929 - DNA, 39 bp, Homo sapiens
cttcacttactgtcagtagcatagctattgcttgctatt

SEQ ID NO: 20930 - DNA, 40 bp, Homo sapiens
gaatttgcgtgtcatccttgcgtagctattgcttgctatt

SEQ ID NO: 20931 - DNA, 39 bp, Homo sapiens
gaaccacctcagtagtgtctgtagctattgcttgctatt

SEQ ID NO: 20932 - DNA, 39 bp, Homo sapiens
ggtcagagcgctgcggtgatgtagctattgcttgctatt

SEQ ID NO: 20933 - DNA, 39 bp, Homo sapiens
agaccttcatgttcagtcagctagctattgcttgctatt

SEQ ID NO: 20934 - DNA, 39 bp, Homo sapiens
gctagcgctgcgttcttcatctagctattgcttgctatt

SEQ ID NO: 20935 - DNA, 40 bp, Homo sapiens
gcttccgagatcagacgagatctagctattgcttgctatt

SEQ ID NO: 20936 - DNA, 41 bp, Homo sapiens
tctgtatcgttccaatttaatgctagctattgcttgctatt

SEQ ID NO: 20937 - DNA, 39 bp, Homo sapiens
gcgtgtcatccttgcgaatgctagctattgcttgctatt

SEQ ID NO: 20938 - DNA, 44 bp, Artificial Sequence
  Synthetic
tattatgcgcgtagcgtaccgaatgctagctattgcttgctatt

SEQ ID NO: 20939 - DNA, 44 bp, Artificial Sequence
  Synthetic
cgcgcataatatcggtacgctaatgctagctattgcttgctatt

SEQ ID NO: 20940 - DNA, 44 bp, Artificial Sequence
  Synthetic
cgaatcgcgtatattatgcgcgatgctagctattgcttgctatt

SEQ ID NO: 20941 - DNA, 44 bp, Artificial Sequence
  Synthetic
ttacgcgtacctatatcgacccatgctagctattgcttgctatt

SEQ ID NO: 20942 - DNA, 44 bp, Artificial Sequence
  Synthetic
cgtcgactatctatatcgacccatgctagctattgcttgctatt

SEQ ID NO: 20943 - DNA, 44 bp, Artificial Sequence
  Synthetic
tatcgcgaactcgccctataacatgctagctattgcttgctatt

SEQ ID NO: 20944 - DNA, 44 bp, Artificial Sequence
  Synthetic
atataagttcgtataactatcgatgctagctattgcttgctatt

SEQ ID NO: 20945 - DNA, 44 bp, Artificial Sequence
  Synthetic
cgattagtatacgaacttatatatgctagctattgcttgctatt

SEQ ID NO: 20946 - DNA, 44 bp, Artificial Sequence
  Synthetic
cgtttcgtacgtcgtcgattcgatgctagctattgcttgctatt

SEQ ID NO: 20947 - DNA, 44 bp, Artificial Sequence
  Synthetic
cgaatcgacgacgcgcataataatgctagctattgcttgctatt

SEQ ID NO: 20948 - DNA, 44 bp, Artificial Sequence
  Synthetic
ttagtatcgaatactaatcgatatgctagctattgcttgctatt

SEQ ID NO: 20949 - DNA, 44 bp, Artificial Sequence; identical to SEQ ID NO: 20945
  Synthetic

SEQ ID NO: 20950 - DNA, 44 bp, Artificial Sequence; identical to SEQ ID NO: 20944
  Synthetic

SEQ ID NO: 20951 - DNA, 44 bp, Artificial Sequence
  Synthetic
ttagtatcgaattcgatactaaatgctagctattgcttgctatt

SEQ ID NO: 20952 - DNA, 25 bp, Artificial Sequence
  Synthetic
gcaatgctagctattgcttgctatt

SEQ ID NO: 20953 - DNA, 24 bp, Artificial Sequence
  Synthetic
gcaatgctagctattgcttgctat

SEQ ID NO: 20954 - DNA, 23 bp, Artificial Sequence
  Synthetic
gcaatgctagctattgcttgcta

SEQ ID NO: 20955 - DNA, 22 bp, Artificial Sequence
  Synthetic
gcaatgctagctattgcttgct

SEQ ID NO: 20956 - DNA, 21 bp, Artificial Sequence
  Synthetic
gcaatgctagctattgcttgc

SEQ ID NO: 20957 - DNA, 20 bp, Artificial Sequence
  Synthetic
gcaatgctagctattgcttg

SEQ ID NO: 20958 - DNA, 19 bp, Artificial Sequence
  Synthetic
gcaatgctagctattgctt

SEQ ID NO: 20959 - DNA, 18 bp, Artificial Sequence
  Synthetic
gcaatgctagctattgct

SEQ ID NO: 20960 - DNA, 17 bp, Artificial Sequence
  Synthetic
gcaatgctagctattgc

SEQ ID NO: 20961 - DNA, 16 bp, Artificial Sequence
  Synthetic
gcaatgctagctattg

SEQ ID NO: 20962 - DNA, 15 bp, Artificial Sequence
  Synthetic
gcaatgctagctatt

SEQ ID NO: 20963 - DNA, 14 bp, Artificial Sequence
  Synthetic
gcaatgctagctat

SEQ ID NO: 20964 - DNA, 13 bp, Artificial Sequence
  Synthetic
gcaatgctagcta

SEQ ID NO: 20965 - DNA, 12 bp, Artificial Sequence
  Synthetic
gcaatgctagct

SEQ ID NO: 20966 - DNA, 11 bp, Artificial Sequence
  Synthetic
gcaatgctagc

SEQ ID NO: 20967 - DNA, 10 bp, Artificial Sequence
  Synthetic
gcaatgctag

SEQ ID NO: 20968 - DNA, 9 bp, Artificial Sequence
  Synthetic
gcaatgcta

SEQ ID NO: 20969 - DNA, 8 bp, Artificial Sequence
  Synthetic
gcaatgct

SEQ ID NO: 20970 - DNA, 7 bp, Artificial Sequence
  Synthetic
gcaatgc

SEQ ID NO: 20971 - DNA, 6 bp, Artificial Sequence
  Synthetic
gcaatg

SEQ ID NO: 20972 - DNA, 5 bp, Artificial Sequence
  Synthetic
gcaat

SEQ ID NO: 20973 - DNA, 60 bp, Artificial Sequence
  Synthetic
tatcctactatacgtatcacatagcgttccgtatgtggccgggatagacctagcttaagc

SEQ ID NO: 20974 - DNA, 59 bp, Artificial Sequence
  Synthetic
tatcctactatacgtatcacatagcgttccgtatgtggccgggatagacctagcttaag

SEQ ID NO: 20975 - DNA, 58 bp, Artificial Sequence
  Synthetic
tatcctactatacgtatcacatagcgttccgtatgtggccgggatagacctagcttaa

SEQ ID NO: 20976 - DNA, 57 bp, Artificial Sequence
  Synthetic
tatcctactatacgtatcacatagcgttccgtatgtggccgggatagacctagctta

SEQ ID NO: 20977 - DNA, 56 bp, Artificial Sequence
  Synthetic
tatcctactatacgtatcacatagcgttccgtatgtggccgggatagacctagctt

SEQ ID NO: 20978 - DNA, 55 bp, Artificial Sequence
  Synthetic
tatcctactatacgtatcacatagcgttccgtatgtggccgggatagacctagct

SEQ ID NO: 20979 - DNA, 54 bp, Artificial Sequence
  Synthetic
tatcctactatacgtatcacatagcgttccgtatgtggccgggatagacctagc

SEQ ID NO: 20980 - DNA, 53 bp, Artificial Sequence
  Synthetic
tatcctactatacgtatcacatagcgttccgtatgtggccgggatagacctag

SEQ ID NO: 20981 - DNA, 52 bp, Artificial Sequence
  Synthetic
tatcctactatacgtatcacatagcgttccgtatgtggccgggatagaccta

SEQ ID NO: 20982 - DNA, 51 bp, Artificial Sequence
  Synthetic
tatcctactatacgtatcacatagcgttccgtatgtggccgggatagacct

SEQ ID NO: 20983 - DNA, 50 bp, Artificial Sequence
  Synthetic
tatcctactatacgtatcacatagcgttccgtatgtggccgggatagacc

SEQ ID NO: 20984 - DNA, 49 bp, Artificial Sequence
  Synthetic
tatcctactatacgtatcacatagcgttccgtatgtggccgggatagac

SEQ ID NO: 20985 - DNA, 48 bp, Artificial Sequence
  Synthetic
tatcctactatacgtatcacatagcgttccgtatgtggccgggataga

SEQ ID NO: 20986 - DNA, 47 bp, Artificial Sequence
  Synthetic
tatcctactatacgtatcacatagcgttccgtatgtggccgggatag

SEQ ID NO: 20987 - DNA, 46 bp, Artificial Sequence
  Synthetic
tatcctactatacgtatcacatagcgttccgtatgtggccgggata

SEQ ID NO: 20988 - DNA, 45 bp, Artificial Sequence
  Synthetic
tatcctactatacgtatcacatagcgttccgtatgtggccgggat

SEQ ID NO: 20989 - DNA, 44 bp, Artificial Sequence
  Synthetic
tatcctactatacgtatcacatagcgttccgtatgtggccggga

SEQ ID NO: 20990 - DNA, 43 bp, Artificial Sequence
  Synthetic
tatcctactatacgtatcacatagcgttccgtatgtggccggg

SEQ ID NO: 20991 - DNA, 42 bp, Artificial Sequence
  Synthetic
tatcctactatacgtatcacatagcgttccgtatgtggccgg

SEQ ID NO: 20992 - DNA, 41 bp, Artificial Sequence
  Synthetic
tatcctactatacgtatcacatagcgttccgtatgtggccg

SEQ ID NO: 20993 - DNA, 40 bp, Artificial Sequence
  Synthetic
tatcctactatacgtatcacatagcgttccgtatgtggcc

SEQ ID NO: 20994 - DNA, 39 bp, Artificial Sequence
  Synthetic
tatcctactatacgtatcacatagcgttccgtatgtggc

SEQ ID NO: 20995 - DNA, 38 bp, Artificial Sequence
  Synthetic
tatcctactatacgtatcacatagcgttccgtatgtgg

SEQ ID NO: 20996 - DNA, 37 bp, Artificial Sequence
  Synthetic
tatcctactatacgtatcacatagcgttccgtatgtg

SEQ ID NO: 20997 - DNA, 36 bp, Artificial Sequence
  Synthetic
tatcctactatacgtatcacatagcgttccgtatgt

SEQ ID NO: 20998 - DNA, 35 bp, Artificial Sequence
  Synthetic
tatcctactatacgtatcacatagcgttccgtatg

SEQ ID NO: 20999 - DNA, 34 bp, Artificial Sequence
  Synthetic
tatcctactatacgtatcacatagcgttccgtat

SEQ ID NO: 21000 - DNA, 33 bp, Artificial Sequence
  Synthetic
tatcctactatacgtatcacatagcgttccgta

SEQ ID NO: 21001 - DNA, 32 bp, Artificial Sequence
  Synthetic
tatcctactatacgtatcacatagcgttccgt

SEQ ID NO: 21002 - DNA, 31 bp, Artificial Sequence
  Synthetic
tatcctactatacgtatcacatagcgttccg

SEQ ID NO: 21003 - DNA, 30 bp, Artificial Sequence
  Synthetic
tatcctactatacgtatcacatagcgttcc

SEQ ID NO: 21004 - DNA, 29 bp, Artificial Sequence
  Synthetic
tatcctactatacgtatcacatagcgttc

SEQ ID NO: 21005 - DNA, 28 bp, Artificial Sequence
  Synthetic
tatcctactatacgtatcacatagcgtt

SEQ ID NO: 21006 - DNA, 27 bp, Artificial Sequence
  Synthetic
tatcctactatacgtatcacatagcgt

SEQ ID NO: 21007 - DNA, 26 bp, Artificial Sequence
  Synthetic
tatcctactatacgtatcacatagcg

SEQ ID NO: 21008 - DNA, 25 bp, Artificial Sequence
  Synthetic
tatcctactatacgtatcacatagc

SEQ ID NO: 21009 - DNA, 24 bp, Artificial Sequence
  Synthetic
tatcctactatacgtatcacatag

SEQ ID NO: 21010 - DNA, 23 bp, Artificial Sequence
  Synthetic
tatcctactatacgtatcacata

SEQ ID NO: 21011 - DNA, 22 bp, Artificial Sequence
  Synthetic
tatcctactatacgtatcacat

SEQ ID NO: 21012 - DNA, 21 bp, Artificial Sequence
  Synthetic
tatcctactatacgtatcaca

SEQ ID NO: 21013 - DNA, 20 bp, Artificial Sequence
  Synthetic
tatcctactatacgtatcac

SEQ ID NO: 21014 - DNA, 19 bp, Artificial Sequence
  Synthetic
tatcctactatacgtatca

SEQ ID NO: 21015 - DNA, 18 bp, Artificial Sequence
  Synthetic
tatcctactatacgtatc

SEQ ID NO: 21016 - DNA, 17 bp, Artificial Sequence
  Synthetic
tatcctactatacgtat

SEQ ID NO: 21017 - DNA, 16 bp, Artificial Sequence
  Synthetic
tatcctactatacgta

SEQ ID NO: 21018 - DNA, 15 bp, Artificial Sequence
  Synthetic
tatcctactatacgt

SEQ ID NO: 21019 - DNA, 14 bp, Artificial Sequence
  Synthetic
tatcctactatacg

SEQ ID NO: 21020 - DNA, 13 bp, Artificial Sequence
  Synthetic
tatcctactatac

SEQ ID NO: 21021 - DNA, 11 bp, Artificial Sequence
  Synthetic
tatcctactat

SEQ ID NO: 21022 - DNA, 10 bp, Artificial Sequence
  Synthetic
tatcctacta

SEQ ID NO: 21023 - DNA, 9 bp, Artificial Sequence
  Synthetic
tatcctact

SEQ ID NO: 21024 - DNA, 8 bp, Artificial Sequence
  Synthetic
tatcctac

SEQ ID NO: 21025 - DNA, 7 bp, Artificial Sequence
  Synthetic
tatccta

SEQ ID NO: 21026 - DNA, 6 bp, Artificial Sequence
  Synthetic
tatcct

SEQ ID NO: 21027 - DNA, 5 bp, Artificial Sequence
  Synthetic
tatcc

SEQ ID NO: 21028 - DNA, 40 bp, Artificial Sequence
  Synthetic
cgaacgataacggatcgttacgatcgataacgaacgataa

SEQ ID NO: 21029 - DNA, 39 bp, Artificial Sequence
  Synthetic
cgaacgataacggatcgttacgatcgataacgaacgata

SEQ ID NO: 21030 - DNA, 38 bp, Artificial Sequence
  Synthetic
cgaacgataacggatcgttacgatcgataacgaacgat

SEQ ID NO: 21031 - DNA, 37 bp, Artificial Sequence
  Synthetic
cgaacgataacggatcgttacgatcgataacgaacga

SEQ ID NO: 21032 - DNA, 36 bp, Artificial Sequence
  Synthetic
cgaacgataacggatcgttacgatcgataacgaacg

SEQ ID NO: 21033 - DNA, 35 bp, Artificial Sequence
  Synthetic
cgaacgataacggatcgttacgatcgataacgaac

SEQ ID NO: 21034 - DNA, 34 bp, Artificial Sequence
  Synthetic
cgaacgataacggatcgttacgatcgataacgaa

SEQ ID NO: 21035 - DNA, 33 bp, Artificial Sequence
  Synthetic
cgaacgataacggatcgttacgatcgataacga

SEQ ID NO: 21036 - DNA, 32 bp, Artificial Sequence
  Synthetic
cgaacgataacggatcgttacgatcgataacg

SEQ ID NO: 21037 - DNA, 31 bp, Artificial Sequence
  Synthetic
cgaacgataacggatcgttacgatcgataac

SEQ ID NO: 21038 - DNA, 30 bp, Artificial Sequence
  Synthetic
cgaacgataacggatcgttacgatcgataa

SEQ ID NO: 21039 - DNA, 29 bp, Artificial Sequence
  Synthetic
cgaacgataacggatcgttacgatcgata

SEQ ID NO: 21040 - DNA, 28 bp, Artificial Sequence
  Synthetic
cgaacgataacggatcgttacgatcgat

SEQ ID NO: 21041 - DNA, 27 bp, Artificial Sequence
  Synthetic
cgaacgataacggatcgttacgatcga

SEQ ID NO: 21042 - DNA, 26 bp, Artificial Sequence
  Synthetic
cgaacgataacggatcgttacgatcg

SEQ ID NO: 21043 - DNA, 25 bp, Artificial Sequence
  Synthetic
cgaacgataacggatcgttacgatc

SEQ ID NO: 21044 - DNA, 24 bp, Artificial Sequence
  Synthetic
cgaacgataacggatcgttacgat

SEQ ID NO: 21045 - DNA, 23 bp, Artificial Sequence
  Synthetic
cgaacgataacggatcgttacga

SEQ ID NO: 21046 - DNA, 22 bp, Artificial Sequence
  Synthetic
cgaacgataacggatcgttacg

SEQ ID NO: 21047 - DNA, 21 bp, Artificial Sequence
  Synthetic
cgaacgataacggatcgttac

SEQ ID NO: 21048 - DNA, 20 bp, Artificial Sequence
  Synthetic
cgaacgataacggatcgtta

SEQ ID NO: 21049 - DNA, 19 bp, Artificial Sequence
  Synthetic
cgaacgataacggatcgtt

SEQ ID NO: 21050 - DNA, 18 bp, Artificial Sequence
  Synthetic
cgaacgataacggatcgt

SEQ ID NO: 21051 - DNA, 17 bp, Artificial Sequence
  Synthetic
cgaacgataacggatcg

SEQ ID NO: 21052 - DNA, 16 bp, Artificial Sequence
  Synthetic
cgaacgataacggatc

SEQ ID NO: 21053 - DNA, 15 bp, Artificial Sequence
  Synthetic
cgaacgataacggat

SEQ ID NO: 21054 - DNA, 14 bp, Artificial Sequence
  Synthetic
cgaacgataacgga

SEQ ID NO: 21055 - DNA, 13 bp, Artificial Sequence
  Synthetic
cgaacgataacgg

SEQ ID NO: 21056 - DNA, 12 bp, Artificial Sequence
  Synthetic
cgaacgataacg

SEQ ID NO: 21057 - DNA, 11 bp, Artificial Sequence
  Synthetic
cgaacgataac

SEQ ID NO: 21058 - DNA, 10 bp, Artificial Sequence
  Synthetic
cgaacgataa

SEQ ID NO: 21059 - DNA, 9 bp, Artificial Sequence
  Synthetic
cgaacgata

SEQ ID NO: 21060 - DNA, 8 bp, Artificial Sequence
  Synthetic
cgaacgat

SEQ ID NO: 21061 - DNA, 7 bp, Artificial Sequence
  Synthetic
cgaacga

SEQ ID NO: 21062 - DNA, 6 bp, Artificial Sequence
  Synthetic
cgaacg

SEQ ID NO: 21063 - DNA, 5 bp, Artificial Sequence
  Synthetic
cgaac

SEQ ID NO: 21064 - DNA, 40 bp, Artificial Sequence
  Synthetic
tgaggtagtaggttgtatagttaaaaaaaaaaaaaaaaaa

SEQ ID NO: 21065 - DNA, 66 bp, Artificial Sequence
  Synthetic
gcgagcacagaattaatacgactcactacgcgttttttttttttaactatacaacctactacctca

SEQ ID NO: 21066 - DNA, 66 bp, Artificial Sequence
  Synthetic
tgaggtagtaggttgtatagttaaaaaaaaaaaacgcgtagtgagtcgtattaattctgtgctcgc

SEQ ID NO: 21067 - DNA, 46 bp, Artificial Sequence
  Synthetic
  misc_feature (46)..(46): n is a, c, g or t
  misc_feature (45)..(45): v is a, c or g
gcgagcacagaattaatacgactcactacgcgttttttttttttvn

SEQ ID NO: 21068 - DNA, 66 bp, Artificial Sequence
  Synthetic
gcgagcacagaattaatacgactcactacccgttttttttttttaactatacaacctactacctca

SEQ ID NO: 21069 - DNA, 66 bp, Artificial Sequence
  Synthetic
tgaggtagtaggttgtatagttaaaaaaaaaaaacgggtagtgagtcgtattaattctgtgctcgc

SEQ ID NO: 21070 - DNA, 66 bp, Artificial Sequence; identical to SEQ ID NO: 21068
  Synthetic

SEQ ID NO: 21071 - DNA, 34 bp, Artificial Sequence
  Synthetic
cagtcatttgggtgaggtagtaggttgtatagtt

SEQ ID NO: 21072 - DNA, 66 bp, Artificial Sequence
  Synthetic
gcgagcacagaattaatacgactcactataggttttttttttttaactatacaacctactacctca

SEQ ID NO: 21073 - DNA, 66 bp, Artificial Sequence
  Synthetic
tgaggtagtaggttgtatagttaaaaaaaaaaaacctatagtgagtcgtattaattctgtgctcgc

The invention claimed is:

1. A method of specifically detecting, identifying and quantifying a plurality of microRNAs in a biological sample obtained from a subject, wherein said plurality of microRNAs differ from each other by at least one nucleotide, said method comprising:
   (a) providing RNA from said sample, wherein said RNA comprises microRNAs;
   (b) polyadenylating the RNA;
   (c) generating a reverse transcript of the polyadenylated RNA using a linear reverse transcript primer, wherein said primer is not complementary to the microRNAs; and
   (d) amplifying the reverse transcript of step (c) and specifically quantifying the plurality of microRNAs by polymerase chain reaction comprising a forward primer, a reverse primer, and a linear probe.

2. The method of claim 1, wherein the biological sample is selected from the group consisting of: biopsy, tissue sample, blood, serum, urine, amniotic fluid, ascitic fluid, saliva, cervical secretions, vaginal secretions, effusions, endometrial secretions, gastrointestinal secretions, bronchial secretions, sputum, pleural effusion, secretions from the breast, secretions from ovarian cyst, and sperm.

3. The method of claim 1, wherein said probe further comprises a minor groove binder.

4. The method of claim 1, wherein the forward primer comprises a sequence selected from the group consisting of any one of SEQ ID NOS: 4168-8334.

5. The method of claim 1, wherein the probe comprises a sequence selected from the group consisting of any one of SEQ ID NOS: 8335-20835.

6. A method of detecting a target RNA nucleic acid in a biological sample, wherein said target RNA nucleic acid sequence is a microRNA or an siRNA, the method comprising:
   (a) providing the biological sample comprising the target RNA nucleic acid sequence;
   (b) annealing the target RNA nucleic acid sequence with a poly(T) primer comprising a 5' universal adaptor sequence;
   (c) generating a reverse transcript of the polyadenylated RNA with the poly(T) primer of step (b); and
   (d) amplifying the reverse transcript of step (c) by a polymerase chain reaction (PCR) comprising a specific forward primer, a universal reverse primer and a specific probe, to generate an amplicon;
   wherein the forward primer is at least partially identical to the target RNA nucleic acid sequence, the universal reverse primer is at least partially identical to a 5' region of the adaptor sequence of the poly (T) primer and the specific probe comprises at least one mismatch at the 3' end of the constant region of the amplicon.

7. The method of claim 6, wherein said target RNA sequence of step (a) is extended at the 3' end by polyadenylation prior to step (b).

8. The method of claim 1, wherein the probe comprises a label.

9. The method of claim 8, wherein the label comprises a fluorophore.

10. The method of claim 9, wherein the label further comprises a quencher molecule, and wherein the fluorophore is located on the probe distal to the quencher molecule.

* * * * *